(12) United States Patent
Zieler et al.

(10) Patent No.: US 10,556,935 B2
(45) Date of Patent: Feb. 11, 2020

(54) COMPOSITIONS FOR IMPROVING CELLS AND ORGANISMS

(71) Applicants: PRIMORDIAL GENETICS INC., Del Mar, CA (US); Helge Zieler, Encinitas, CA (US); Sabrina German, San Diego, CA (US); Animesh Ray, Claremont, CA (US); Biranchi Narayan Patra, Claremont, CA (US)

(72) Inventors: Helge Zieler, Encinitas, CA (US); Sabrina German, San Diego, CA (US); Animesh Ray, Claremont, CA (US); Biranchi Narayan Patra, Claremont, CA (US)

(73) Assignee: PRIMORDIAL GENETICS INC., Del Mar, CA (US)

(*) Notice: Subject to any disclaimer, the term of this patent is extended or adjusted under 35 U.S.C. 154(b) by 54 days.

(21) Appl. No.: 15/500,803

(22) PCT Filed: Jul. 31, 2015

(86) PCT No.: PCT/US2015/043285
§ 371 (c)(1),
(2) Date: Jan. 31, 2017

(87) PCT Pub. No.: WO2016/019337
PCT Pub. Date: Feb. 4, 2016

(65) Prior Publication Data
US 2017/0218033 A1 Aug. 3, 2017

Related U.S. Application Data

(60) Provisional application No. 62/031,624, filed on Jul. 31, 2014.

(51) Int. Cl.
*C07K 14/395* (2006.01)
*C12N 15/81* (2006.01)
*C12N 15/70* (2006.01)
*C12N 15/10* (2006.01)

(52) U.S. Cl.
CPC ........ *C07K 14/395* (2013.01); *C12N 15/1093* (2013.01); *C12N 15/70* (2013.01); *C12N 15/81* (2013.01); *C07K 2319/00* (2013.01)

(58) Field of Classification Search
None
See application file for complete search history.

(56) References Cited

U.S. PATENT DOCUMENTS 8,426,206 B2 4/2013 Salort et al.
2014/0170708 A1 6/2014 Zieler

FOREIGN PATENT DOCUMENTS

WO 2002070647 A2 9/2002

OTHER PUBLICATIONS

Arroyo-Lopez et al., Effects of temperature, pH and sugar concentration on the growth parameters of *Saccharomyces* cerevisiae, S. kudriavzevii and their interspecific hybrid, Int. J Food Microbiology, Feb. 5, 2009, vol. 131, pp. 120-127. entire document.
Ashby MK and Houmard J. Cyanobacterial two-component proteins: structure, diversity, distribution, and evolution, Microbiol Mol Biol Rev. 2006; 70(2):472-509.
Babushok et al. Current topics in genome evolution: molecular mechanisms of new gene formation. Cell Mol Life Sci. 2007; 64(5):542-54.
Bianci A., Shore D., The KEOPS complex, a rosetta stone for telomere regulation, 2006,/cekk /vik 124 (6), p. 1125-1128.
Brachmann et al. Designer deletion strains derived from *Saccharomyces* cerevisiae S288C: a useful set of strains and plasmids for PCR-mediated gene disruption and other applications.Yeast 1998; 14(2):115-132.
Cakar ZP et al. Evolutionary engineering of *Saccharomyces* cerevisiae for improved industrially important properties. FEMS Yeast Res. 2012, 12(2):171-182.
Dismukes et al. Aquatic phototrophs: efficient alternatives to land-based crops for biofuels. Current Opinion in Biotechnology, 2008; 19(3):235-240.
Dogan A, et al. Improvements of tolerance to stress conditions by genetic engineering in *Saccharomyces* cerevisiae during ethanol production. Appl Biochem Biotechnol. 2014; 174(1):28-42.
Dubouloz F. et al. The TOR and EGO protein complexes orchestrate microautophagy in yeast. Mol Cell. 2005, 19(1):15-26.
Downey M, et al, A genome-wide screen identifies the evolutionally conserved KEOPS complex as a telomere regulator, Cell 2006, 126(6): 1155-1168.
Eisenbeis and Hocker. Evolutionary mechanism as a template for protein engineering. J Pept Sci. 2010; 16(10):538-544.
Funk M et al., Vector systems for heterologous expression of proteins in *Saccharomyces* cerevisiae, Methods Enzymology, 2002, 350:248-57.
Gao M, et al. A conserved GTPase-containing complex is required for intracellular sorting of the general amino-acid permease in yeast. Nat Cell Biol. 2006; 8(7):657-667.
Gietz RD and Woods. Transformation of yeast by lithium acetate/ single-stranded carrier DNA/polyethylene glycol method, Methods Enzymology, 2002; 350:87-96.
Gietz RD and Schiestli, High-efficiency yeast transformation using the LiAc/SS carrier DNA/PEG method, Nature Protocols, 2007; 2(1):31-34.

(Continued)

*Primary Examiner* — Robert A Zeman
(74) *Attorney, Agent, or Firm* — Gorman IP Law, APC

(57) ABSTRACT

The present invention provides compositions comprising randomized in-frame fusion polynucleotides and methods for introducing them into a host organism to obtain desirable phenotypic changes that modulate tolerance to stress, thus creating novel characteristics of the transformed organism.

7 Claims, 8 Drawing Sheets
(6 of 8 Drawing Sheet(s) Filed in Color)
Specification includes a Sequence Listing.

(56) References Cited

OTHER PUBLICATIONS

Gietz RD and Woods. Yeast transformation by the LiAc/SS Carrier DNA/PEG method, Methods in Molecular Biology, 2006; 313:107-120.
Gietz RD, Woods RA. Genetic transformation of yeast. Biotechniques, 2001, 30(4):816-826.
Gilbert W, Why genes in pieces? Nature 1978; 271(5645):501.
Inaki K, Liu ET, Structural mutations in cancer: mechanistic and functional insights, Trends Genetics, 2012, vol. 28 (11):550-559.
International Search Report, Form PCT/ISA/210, dated Nov. 24, 2015.
Kaida D, et al., Yeast Whi2 and Psr1-phosphatase form a complex and regulate STRE-mediated gene expression. Genes Cells, 2002; vol. 7(6):543-552.
Kawai S, et al. Transformation of *Saccharomyces* cerevisiae and other fungi: methods and possible underlying mechanism. Bioeng Bugs. Nov.-Dec. 2010;1(6):395-403.
Kelly et al. Transcript characterization, gene disruption and nucleotide sequence of the *Saccharomyces cerevisiae* WHI2 gene, Gene, 30 Jun. 1988, vol. 66, pp. 205-213. entire document.
Klinke HB, et al. Inhibition of ethanol producing yeast and bacteria by degradation products produced during pre-treatment of biomass. Appl Microbiol Biotechnol. 2004; 66(1):10-16.
Leadsham JE, et al., Whi2p links nutritional sensing to actin-dependent Ras-cAMP-PKA regulation and apoptosis in yeast. J Cell Science 2009, vol. 122(pt5):706-715.
Liu ZL, et al. Adaptive response of yeasts to furfural and 5-hydroxymethylfurfural and new chemical evidence for HMF conversion to 2,5-bis-hydroxymethylfuran. J Ind Microbiol Biotechnol. 2004; 31(8):345-352.
Luo C, et al. Identification of potential fermentation inhibitors in conversion of hybrid poplar hydrolyzate to ethanol. Biomass Bioenergy 2002; 22(2):125-138.
Marschalek. Mechanisms of leukemogenesis by MLL fusion proteins. Br J Haematol. 2011; 152(2):141-154.
Martin C, et al. Comparison of the resistance of industrial and laboratory strains of *Saccharomyces* and lygosaccharomyces to lignocellulose-derived fermentation inhibitors. Enzyme Microbial Technol. 2003; 32(3-4)386-395.
Melo JV, The diversity of BCR-ABL fusion proteins and their relationship to leukemia phenotype. Blood 1996; 88 (7):2375-2384.
Mendl N, et al., Mitophagy in yeast is independent of mitochondrial fussion and requires the stress respnse gene WHI2. J Cell Science 2011, 124(8):1339-1350.
Mitelman et al. Fusion genes and rearranged genes as a linear function of chromosome aberrations in cancer. Nat Genet. 2004; 36(4):331-334.
Mitelman et al. The impact of translocations and gene fusions on cancer causation. Nat Rev Cancer 2007; 7(4):233-245.
Modig T, et al. Inhibition effects of furfural on alcohol dehydrogenase, aldehyde dehydrogenase and pyruvate dehydrogenase. Biochem J. 2002; 363(3):769-776.
Mountain HA, and Sudberry PE, Regulation of the *Saccharomyces* cerevisiae WHI2 gene. J Gen Microbiology 1990; 136(4): 727-732.
Mountain HA, and Sudberry PE, The relationship of growth rate and catabolite repression with WHI2 expression and cell size in *Saccharomyces* cerevisiae. J Gen Microbiology 1990a; 136(4): 727-732.
Muller M, et al. Mitophagy, mitochondrial dynamics and the general stress response in yeast. Biochem Soc Trans. 2011; 39(5):1514-1519.
Mumberg D, et al. Yeast vectors for the controlled expression of heterologous proteins in different genetic backgrounds. Gene 1995; 156(1):119-122.
Nieves LM, et al. Engineering Sugar Utilization and Microbial Tolerance toward Lignocellulose Conversion. Front Bioeng Biotechnol. 2015; 3:17.
Piper RC. Successful transporter gets an EGO boost. 2006; Dev Cell. 11(1):6-7.
Rabbitts TH. Commonality but diversity in cancer gene fusions. Cell 2009; 137(3):391-395.
Radcliffe PA, et al. Filamentous growth of the budding yeast *Saccharomyces* cerevisiae induced by overexpression of the WHI2 gene. Microbiology 1997; 143(6):1867-1876.
Saha BC. Hemicellulose bioconversion. J Ind Microbiol Biotechnology 2003; 30(5):279-291.
Sambrook J et al, Molecular Cloning: A Laboratory Manual, Second Ed., 1989, Cold Spring Harbor Laboratory Press, Plainview, New York.
Saul DJ and Sudbery PE. Molecular coloning of WHI2, a gene involved in the regulation of cell proliferation in *Saccharomyses* cereviciae, J Gen Microbiology 1985; 131(7):1797-1806.
Sawyers. The bcr-abl gene in chronic myelogenous leukaemia. Cancer Surv. 1992; 15:37-51.
Sikorski RS and Meter P. A system of shuttle vectors and yeast host strains designed for efficient manipulation of DAN *Saccharomyces* cerevisiae. Genetics 1989; 122(1):19:27.
Whitworth and Cock. Evolution of prokaryotic two-component systems: insights from comparative genomics. Amino Acids 2009; 37(3):459-66.
Zhang, Fisher, and Mobashery. The bifunctional enzymes of antibiotic resistance. Curr Opin Microbiol.2009; 12(5):505-511.
Zaldivar J, et al. Fuel ethanol production from lignocellulose: a challenge for metabolic engineering and process integration. Appl Microbiol Biotechnol., 2001, 56(1-2):17-34.

Figure 1

| Table 5A | | | | | | | | |
|---|---|---|---|---|---|---|---|---|
| | | | | | \multicolumn{4}{c}{Number of surviving cells} | | | |
| | | | | | Heat (42°C) | | 15% ethanol | |
| Gene name | Nuc-leic acid SEQ ID | Pro-tein SEQ ID | 5' ORF name | 3' ORF name | Mean | Std Dev. | Mean | Std Dev. |
| Y1-5A | 1 | 64 | YDR246W-A | WHI2 | 148,500 | 17,070 | 76,667 | 13,053 |
| Y1-13A | 4 | 67 | PAC11 | WHI2 | 13,333 | 4,110 | 175,000 | 18,954 |
| Y1-38A | 15 | 78 | CGI121 | WHI2 | 13,500 | 3,145 | 160,000 | 23,882 |
| Y1-39B | 16 | 79 | YLR466C-B | WHI2 | 26,000 | 3,311 | 189,167 | 39,099 |
| Y1-40A | 17 | 80 | YDL109C | WHI2 | 3,167 | 1,139 | 190,000 | 23,413 |
| M21-A02 | 28 | 91 | WHI2 | RPS4B | 32,167 | 5,399 | 229,167 | 30,108 |
| M21-A04 | 30 | 93 | TRX2 | WHI2 | 43,833 | 8,967 | 121,667 | 23,805 |
| M21-C08 | 32 | 95 | SLM4 | WHI2 | 20,500 | 3,000 | 198,333 | 33,720 |
| M21-D06 | 33 | 96 | SNN1 | WHI2 | 37,667 | 4,405 | 214,167 | 44,085 |
| M22-C01 | 34 | 97 | TEF1 | WHI2 | 20,833 | 7,391 | 225,000 | 30,490 |
| M22-C05 | 35 | 98 | PCC1 | WHI2 | 35,833 | 3,939 | 112,500 | 14,240 |
| M22-D01 | 36 | 99 | RPR2 | WHI2 | 34,167 | 11,955 | 101,667 | 12,323 |
| M23-C03 | 37 | 100 | GON7 | WHI2 | 1,833 | 839 | 346,667 | 31,856 |
| M23-E02 | 40 | 103 | HYP2 | WHI2 | 110,167 | 10,348 | 256,667 | 23,727 |
| M24-A05 | 43 | 106 | MSO1 | WHI2 | 118,167 | 24,033 | 452,500 | 76,661 |
| M24-B12 | 44 | 107 | TPP1 | WHI2 | 3,167 | 1,139 | 95,000 | 9,623 |
| M24-F06 | 47 | 110 | CUP1-2 | WHI2 | 44,333 | 6,098 | 278,333 | 57,252 |
| M25-G08 | 50 | 113 | FCY1 | WHI2 | 96,333 | 14,241 | 125,833 | 24,851 |
| M27-B07 | 56 | 119 | WHI2 | CGI121 | 3,333 | 1,217 | 117,500 | 42,546 |
| YGD29 | 143 | 181 | YDR246W-A | - | 0 | 0 | 0 | 0 |
| YGD30 | 144 | 182 | PAC11 | - | 0 | 0 | 0 | 0 |
| YGD31 | 145 | 183 | CGI121 | - | 0 | 0 | 0 | 0 |
| YGD32 | 146 | 184 | YLR466C-B | - | 0 | 0 | 0 | 0 |
| YGD33 | 147 | 185 | YDL109C | - | 0 | 0 | 0 | 0 |
| YGD34 | 148 | 186 | TRX2 | - | 0 | 0 | 0 | 0 |
| YGD35 | 149 | 187 | SLM4 | - | 0 | 0 | 0 | 0 |
| YGD36 | 150 | 188 | SNN1 | - | 0 | 0 | 0 | 0 |

Figure 1 (continued)

| YGD37 | 151 | 189 | TEF1 | - | 0 | 0 | 0 | 0 |
|---|---|---|---|---|---|---|---|---|
| YGD38 | 152 | 190 | PCC1 | - | 0 | 0 | 0 | 0 |
| YGD39 | 153 | 191 | RPR2 | - | 0 | 0 | 0 | 0 |
| YGD40 | 154 | 192 | GON7 | - | 0 | 0 | 0 | 0 |
| YGD41 | 155 | 193 | HYP2 | - | 0 | 0 | 0 | 0 |
| YGD42 | 156 | 194 | MSO1 | - | 0 | 0 | 0 | 0 |
| YGD43 | 157 | 195 | TPP1 | - | 0 | 0 | 0 | 0 |
| YGD44 | 158 | 196 | CUP1-2 | - | 0 | 0 | 0 | 0 |
| YGD45 | 159 | 197 | FCY1 | - | 0 | 0 | 0 | 0 |
| YGD46 | 160 | 198 | RPS4B | - | 0 | 0 | 0 | 0 |
| YGD53 | 129 | 167 | WHI2 | - | 35,833 | 5,059 | 53,333 | 19,052 |
| p466-TEF1 | 128 | - | - | - | 0 | 0 | 0 | 0 |

Figure 2

| Table 5B | | | | | | | | |
|---|---|---|---|---|---|---|---|---|
| | | | | | colspan="4" | Number of surviving cells | | |
| | | | | | colspan="2" | 3% butanol | colspan="2" | pH 3.0 |
| Gene name | Nucleic acid SEQ ID | Protein SEQ ID | 5' ORF name | 3' ORF name | Mean | Std Dev. | Mean | Std Dev. |
| Y1-5A | 1 | 64 | YDR246W-A | WHI2 | 3,500 | 1,478 | 379,167 | 55,802 |
| Y1-13A | 4 | 67 | PAC11 | WHI2 | 5,000 | 1,587 | 375,000 | 27,420 |
| Y1-38A | 15 | 78 | CGI121 | WHI2 | 8,000 | 2,373 | 428,333 | 47,571 |
| Y1-39B | 16 | 79 | YLR466C-B | WHI2 | 19,667 | 6,475 | 476,667 | 69,389 |
| Y1-40A | 17 | 80 | YDL109C | WHI2 | 39,667 | 3,631 | 261,667 | 37,859 |
| M21-A02 | 28 | 91 | WHI2 | RPS4B | 16,833 | 1,262 | 458,333 | 72,699 |
| M21-A04 | 30 | 93 | TRX2 | WHI2 | 35,500 | 4,910 | 486,667 | 19,626 |
| M21-C08 | 32 | 95 | SLM4 | WHI2 | 22,000 | 3,311 | 400,000 | 43,205 |
| M21-D06 | 33 | 96 | SNN1 | WHI2 | 19,667 | 6,810 | 448,333 | 23,960 |
| M22-C01 | 34 | 97 | TEF1 | WHI2 | 109,333 | 18,086 | 500,000 | 64,636 |
| M22-C05 | 35 | 98 | PCC1 | WHI2 | 18,500 | 4,333 | 235,833 | 27,806 |
| M22-D01 | 36 | 99 | RPR2 | WHI2 | 12,667 | 1,440 | 392,500 | 81,394 |
| M23-C03 | 37 | 100 | GON7 | WHI2 | 17,667 | 3,981 | 866,667 | 117,757 |
| M23-E02 | 40 | 103 | HYP2 | WHI2 | 36,167 | 4,435 | 433,333 | 44,555 |
| M24-A05 | 43 | 106 | MSO1 | WHI2 | 99,000 | 16,595 | 409,167 | 30,231 |
| M24-B12 | 44 | 107 | TPP1 | WHI2 | 13,333 | 5,361 | 249,167 | 56,789 |
| M24-F06 | 47 | 110 | CUP1-2 | WHI2 | 32,500 | 10,218 | 530,000 | 64,521 |
| M25-G08 | 50 | 113 | FCY1 | WHI2 | 4,167 | 1,374 | 426,667 | 67,385 |
| M27-B07 | 56 | 119 | WHI2 | CGI121 | 16,833 | 1,753 | 325,833 | 58,650 |
| YGD29 | 143 | 181 | YDR246W-A | - | 0 | 0 | 0 | 0 |
| YGD30 | 144 | 182 | PAC11 | - | 0 | 0 | 0 | 0 |
| YGD31 | 145 | 183 | CGI121 | - | 0 | 0 | 0 | 0 |
| YGD32 | 146 | 184 | YLR466C-B | - | 0 | 0 | 0 | 0 |
| YGD33 | 147 | 185 | YDL109C | - | 0 | 0 | 0 | 0 |
| YGD34 | 148 | 186 | TRX2 | - | 0 | 0 | 0 | 0 |
| YGD35 | 149 | 187 | SLM4 | - | 0 | 0 | 0 | 0 |

Figure 2 (continued)

| YGD36 | 150 | 188 | SNN1 | - | 0 | 0 | 0 | 0 |
|---|---|---|---|---|---|---|---|---|
| YGD37 | 151 | 189 | TEF1 | - | 0 | 0 | 0 | 0 |
| YGD38 | 152 | 190 | PCC1 | - | 0 | 0 | 0 | 0 |
| YGD39 | 153 | 191 | RPR2 | - | 0 | 0 | 0 | 0 |
| YGD40 | 154 | 192 | GON7 | - | 0 | 0 | 0 | 0 |
| YGD41 | 155 | 193 | HYP2 | - | 0 | 0 | 0 | 0 |
| YGD42 | 156 | 194 | MSO1 | - | 0 | 0 | 0 | 0 |
| YGD43 | 157 | 195 | TPP1 | - | 0 | 0 | 0 | 0 |
| YGD44 | 158 | 196 | CUP1-2 | - | 0 | 0 | 0 | 0 |
| YGD45 | 159 | 197 | FCY1 | - | 0 | 0 | 0 | 0 |
| YGD46 | 160 | 198 | RPS4B | - | 0 | 0 | 0 | 0 |
| YGD53 | 129 | 167 | WHI2 | - | 5,167 | 638 | 197,500 | 12,874 |
| p466-TEF1 | 128 | - | - | - | 0 | 0 | 0 | 0 |

Figure 3

| Table 6A | | | | | | | | |
|---|---|---|---|---|---|---|---|---|
| | | | | | \multicolumn{4}{c}{Number of surviving cells} | | | |
| | | | | | Heat (42°C) | | 15% ethanol | |
| Gene name | Nucleic acid SEQ ID | Protein SEQ ID | 5' ORF name | 3' ORF name | Mean | Std Dev. | Mean | Std Dev. |
| PP0219 | 205 | 225 | BUD32 | WHI2 | 3,111 | 1,018 | 136,667 | 16,667 |
| PP0220 | 206 | 226 | GON7 | WHI2 | 2,667 | 2,000 | 204,444 | 27,756 |
| PP0221 | 207 | 227 | KAE1 | WHI2 | 3,556 | 1,388 | 110,000 | 26,034 |
| PP0222 | 208 | 228 | PCC1 | WHI2 | 62,667 | 9,333 | 353,333 | 26,034 |
| PP0223 | 209 | 229 | CGI121 | WHI2 | 3,778 | 2,037 | 111,111 | 15,753 |
| PP0224 | 210 | 230 | SLM4 | WHI2 | 39,556 | 7,128 | 366,667 | 24,037 |
| PP0225 | 211 | 231 | GTR2 | WHI2 | 34,667 | 2,906 | 274,444 | 35,642 |
| PP0226 | 212 | 232 | LTV1 | WHI2 | 2,667 | 1,333 | 113,333 | 35,277 |
| PP0227 | 213 | 233 | MEH1 | WHI2 | 8,889 | 2,341 | 85,556 | 20,092 |
| PP0228 | 214 | 234 | GTR1 | WHI2 | 22,000 | 2,000 | 390,000 | 15,275 |
| PP0229 | 215 | 235 | WHI2 | BUD32 | 0 | 0 | 103,333 | 25,166 |
| PP0230 | 216 | 236 | WHI2 | GON7 | 667 | 1,155 | 180,000 | 15,275 |
| PP0231 | 217 | 237 | WHI2 | KAE1 | 0 | 0 | 24,444 | 10,184 |
| PP0232 | 218 | 238 | WHI2 | PCC1 | 0 | 0 | 208,889 | 30,062 |
| PP0233 | 219 | 239 | WHI2 | CGI121 | 0 | 0 | 81,111 | 8,389 |
| PP0234 | 220 | 240 | WHI2 | SLM4 | 47,556 | 6,012 | 304,444 | 36,717 |
| PP0235 | 221 | 241 | WHI2 | GTR2 | 667 | 1,155 | 87,778 | 20,367 |
| PP0236 | 222 | 242 | WHI2 | LTV1 | 16,000 | 2,667 | 158,889 | 30,062 |
| PP0237 | 223 | 243 | WHI2 | MEH1 | 56,667 | 5,292 | 247,778 | 16,443 |
| PP0238 | 224 | 244 | WHI2 | GTR1 | 10,000 | 1,333 | 0 | 0 |
| YGD31 | 145 | 183 | CGI121 | - | 0 | 0 | 0 | 0 |
| YGD35 | 149 | 187 | SLM4 | - | 0 | 0 | 0 | 0 |
| YGD38 | 152 | 190 | PCC1 | - | 0 | 0 | 0 | 0 |
| YGD40 | 154 | 192 | GON7 | - | 0 | 0 | 0 | 0 |
| YGD47 | 161 | 199 | BUD32 | - | 0 | 0 | 0 | 0 |
| YGD48 | 162 | 200 | KAE1 | - | 0 | 0 | 0 | 0 |
| YGD49 | 163 | 201 | GTR2 | - | 0 | 0 | 0 | 0 |
| YGD50 | 164 | 202 | LTV1 | - | 0 | 0 | 0 | 0 |
| YGD51 | 165 | 203 | MEH1 | - | 0 | 0 | 0 | 0 |
| YGD52 | 166 | 204 | GTR1 | - | 0 | 0 | 0 | 0 |
| YGD53 | 129 | 167 | WHI2 | - | 0 | 0 | 134,444 | 6,939 |
| p466-TEF1 | - | - | - | - | 0 | 0 | 0 | 0 |

Figure 4

| Table 6B | | | | | | | | |
|---|---|---|---|---|---|---|---|---|
| | | | | | Number of surviving cells | | | |
| | | | | | 3% butanol | | pH 3.0 | |
| Gene name | Nucleic acid SEQ ID | Protein SEQ ID | 5' ORF name | 3' ORF name | Mean | Std Dev. | Mean | Std Dev. |
| PP0219 | 205 | 225 | BUD32 | WHI2 | 2,222 | 1,018 | 402,222 | 20,367 |
| PP0220 | 206 | 226 | GON7 | WHI2 | 11,556 | 1,678 | 376,667 | 34,801 |
| PP0221 | 207 | 227 | KAE1 | WHI2 | 10,000 | 2,404 | 173,333 | 30,551 |
| PP0222 | 208 | 228 | PCC1 | WHI2 | 21,333 | 2,667 | 626,667 | 13,333 |
| PP0223 | 209 | 229 | CGI121 | WHI2 | 2,444 | 1,018 | 238,889 | 25,892 |
| PP0224 | 210 | 230 | SLM4 | WHI2 | 17,333 | 1,764 | 604,444 | 73,434 |
| PP0225 | 211 | 231 | GTR2 | WHI2 | 17,111 | 1,678 | 502,222 | 46,825 |
| PP0226 | 212 | 232 | LTV1 | WHI2 | 3,778 | 1,018 | 303,333 | 21,858 |
| PP0227 | 213 | 233 | MEH1 | WHI2 | 444 | 770 | 177,778 | 31,505 |
| PP0228 | 214 | 234 | GTR1 | WHI2 | 24,889 | 4,018 | 615,556 | 44,389 |
| PP0229 | 215 | 235 | WHI2 | BUD32 | 2,444 | 1,388 | 84,444 | 13,472 |
| PP0230 | 216 | 236 | WHI2 | GON7 | 8,667 | 2,906 | 303,333 | 18,559 |
| PP0231 | 217 | 237 | WHI2 | KAE1 | 222 | 385 | 56,667 | 15,275 |
| PP0232 | 218 | 238 | WHI2 | PCC1 | 11,333 | 667 | 265,556 | 15,031 |
| PP0233 | 219 | 239 | WHI2 | CGI121 | 1,111 | 385 | 216,667 | 12,019 |
| PP0234 | 220 | 240 | WHI2 | SLM4 | 13,333 | 1,333 | 285,556 | 28,739 |
| PP0235 | 221 | 241 | WHI2 | GTR2 | 889 | 1,018 | 244,444 | 13,878 |
| PP0236 | 222 | 242 | WHI2 | LTV1 | 5,111 | 2,037 | 298,889 | 32,375 |
| PP0237 | 223 | 243 | WHI2 | MEH1 | 17,111 | 2,341 | 375,556 | 33,389 |
| PP0238 | 224 | 244 | WHI2 | GTR1 | 10,222 | 1,388 | 270,000 | 21,858 |
| YGD31 | 145 | 183 | CGI121 | - | 0 | 0 | 0 | 0 |
| YGD35 | 149 | 187 | SLM4 | - | 0 | 0 | 0 | 0 |
| YGD38 | 152 | 190 | PCC1 | - | 0 | 0 | 0 | 0 |
| YGD40 | 154 | 192 | GON7 | - | 0 | 0 | 0 | 0 |
| YGD47 | 161 | 199 | BUD32 | - | 0 | 0 | 0 | 0 |
| YGD48 | 162 | 200 | KAE1 | - | 0 | 0 | 0 | 0 |
| YGD49 | 163 | 201 | GTR2 | - | 0 | 0 | 0 | 0 |
| YGD50 | 164 | 202 | LTV1 | - | 0 | 0 | 0 | 0 |
| YGD51 | 165 | 203 | MEH1 | - | 0 | 0 | 0 | 0 |
| YGD52 | 166 | 204 | GTR1 | - | 0 | 0 | 0 | 0 |
| YGD53 | 129 | 167 | WHI2 | - | 9,111 | 1,678 | 355,556 | 16,777 |
| p466-TEF1 | - | - | - | - | 0 | 0 | 0 | 0 |

Figure 5

| Table 7A | | | | | | | | | |
|---|---|---|---|---|---|---|---|---|---|
| | | | | | Activity scores | | | | |
| Gene name | Nucleic acid SEQ ID | Protein SEQ ID | 5' ORF name | 3' ORF name | Heat | 15% Ethanol | 3% Butanol | pH 3 | Salt |
| Y1-23A | 10 | 73 | YFL066C | WHI2 | 2.33 | 0.00 | 0.83 | 0.33 | 0.00 |
| M21-A03 | 29 | 92 | WHI2 | GIS3 | 2.00 | 3.00 | 3.00 | 3.00 | 3.00 |
| M21-A09 | 31 | 94 | YCH1 | WHI2 | 1.33 | 0.67 | 0.00 | 0.67 | 0.00 |
| M23-D02 | 38 | 101 | ICY2 | NCE101 | 0.67 | 0.00 | 0.83 | 0.67 | 1.00 |
| M23-F02 | 41 | 104 | ICY2 | WHI2 | 1.67 | 3.00 | 3.00 | 3.00 | 3.00 |
| M24-E05 | 46 | 109 | YCH1 | GIS3 | 0.33 | 2.00 | 1.67 | 1.67 | 2.33 |
| YGD1 | 129 | 167 | WHI2 | - | 1.67 | 0.17 | 0.00 | 0.00 | 0.67 |
| YGD2 | 130 | 168 | GIS3 | - | 0.33 | 0.00 | 0.33 | 0.00 | 0.00 |
| YGD4 | 132 | 170 | ICY2 | - | 1.00 | 0.00 | 0.00 | 1.00 | 0.00 |
| YGD6 | 133 | 171 | YFL066C | - | 0.00 | 0.00 | 0.17 | 0.00 | 0.00 |
| YGD7 | 134 | 172 | YCH1 | - | 0.00 | 0.00 | 0.00 | 0.00 | 0.00 |
| YGD11 | 136 | 174 | NCE101 | - | 0.00 | 0.00 | 0.00 | 0.00 | 0.00 |
| p416-GAL1 | 127 | - | - | - | 0.00 | 0.00 | 0.00 | 0.00 | 0.00 |

Figure 6

| Table 7B | | | | | | | | | |
|---|---|---|---|---|---|---|---|---|---|
| | | | | | Activity scores | | | | |
| Gene name | Nucleic acid SEQ ID | Protein SEQ ID | 5' ORF name | 3' ORF name | Heat | 15% Ethanol | 3% Butanol | pH 3 | Salt |
| Y1-17A | 5 | 68 | WHI2 | YJL185C | 1.00 | 1.00 | 0.00 | 1.00 | 0.00 |
| Y1-19A | 7 | 70 | WHI2 | YFL066C | 3.00 | 3.00 | 2.00 | 3.00 | 0.00 |
| Y1-20A | 8 | 71 | WSC4 | WHI2 | 2.50 | 2.00 | 1.50 | 2.00 | 0.00 |
| Y1-23A | 10 | 73 | YFL066C | WHI2 | 0.00 | 1.00 | 1.00 | 1.00 | 0.50 |
| Y1-28A | 12 | 75 | DLS1 | WHI2 | 2.00 | 2.00 | 2.00 | 2.00 | 0.00 |
| Y1-33A | 13 | 76 | GIS3 | SBA1 | 0.00 | 1.00 | 0.75 | 3.00 | 0.25 |
| Y1-43A | 18 | 81 | YLR154C-G | WHI2 | 3.00 | 3.00 | 2.25 | 2.00 | 0.00 |
| Y1-48A | 21 | 84 | ATR1 | WHI2 | 2.00 | 3.00 | 2.00 | 3.00 | 0.00 |
| Y1-66C | 25 | 88 | YGL235W | SSQ1 | 1.00 | 0.00 | 0.00 | 0.00 | 1.00 |
| YGD1 | 129 | 167 | WHI2 | - | 0.00 | 2.00 | 0.50 | 2.00 | 0.00 |
| YGD2 | 130 | 168 | GIS3 | - | 0.00 | 0.00 | 0.00 | 2.00 | 0.00 |
| YGD3 | 131 | 169 | YLR154C-G | - | 0.00 | 0.00 | 0.00 | 0.00 | 0.50 |
| YGD6 | 133 | 171 | YFL066C | - | 0.00 | 0.00 | 0.00 | 0.00 | 0.00 |
| YGD10 | 135 | 173 | SBA1 | - | 0.00 | 0.00 | 0.00 | 0.00 | 0.00 |
| YGD16 | 137 | 175 | WSC4 | - | 0.00 | 0.00 | 0.00 | 0.00 | 0.00 |
| YGD17 | 138 | 176 | YGL235W | - | 0.00 | 0.00 | 0.00 | 1.00 | 0.00 |
| YGD18 | 139 | 177 | SSQ1 | - | 0.00 | 0.00 | 0.00 | 0.00 | 0.00 |
| YGD19 | 140 | 178 | ATR1 | - | 0.00 | 0.00 | 0.00 | 0.00 | 0.00 |
| YGD20 | 141 | 179 | DLS1 | - | 0.00 | 0.00 | 0.00 | 0.00 | 0.00 |
| YGD23 | 142 | 180 | YJL185C | - | 0.00 | 0.00 | 0.00 | 0.50 | 0.00 |
| p416-GAL1 | 127 | - | - | - | 0.00 | 0.00 | 0.00 | 0.00 | 0.00 |

COMPOSITIONS FOR IMPROVING CELLS AND ORGANISMS

This application is the National Phase Under 35 U.S.C. § 371 of PCT International Application No. PCT/US15/43285 filed on Jul. 31, 2015, which claims priority under 35 U.S.C. § 119(e) on U.S. Provisional Application No. 62/031,624 filed on Jul. 31, 2014, the entire contents of each of which are hereby incorporated by reference.

FIELD OF THE INVENTION

This invention relates to non-naturally occurring fusion polynucleotides encoding fusion polypeptides and methods of introducing the fusion polynucleotides into host organisms to generate new and/or improved phenotypes.

BACKGROUND OF THE INVENTION

Currently, there is a shift to biological systems for production of a variety of chemicals and fuels, and a wide assortment of organisms are and will be used, most of them microbes, with an increasing tendency towards photosynthetic organisms (Dismukes 2008). The ability to grow robustly, the ability to resist toxic compounds, abiotic stresses, changes in growth conditions, and efficient production of the materials and compounds of interest, are desirable properties of these organisms.

Yeasts are widely employed as fermentation organisms for the production of ethanol, butanol, isobutanol and other alcohols, and a variety of commodity and fine chemicals. Yeasts used for bio-production include the baker's yeast *Saccharomyces cerevisiae*; other *Saccharomyces* species; *Schizosaccharomyces pombe*; *Kluyveromyces* species such as *K. lactis, K. marxianus* and *K. thermotolerans; Candida* species such as *C. albicans, C. glabrata, C. stellate, C. tropicalis, C. dubliniensis* and *C. keroseneae; Pichia* species such as *P. angusta, P. anomala, P. membranifaciens* and *P. pastoris*; oleaginous yeasts such as *Yarrowia lipolytica*; and other yeast species such as *Dekkera/Brettanomyces* species, *Brettanomyces bruxellensis, Torulaspora delbrueckii* and *Zygosaccharomyces bailii*.

Many biological production systems using *S. cerevisiae* and other eukaryotic and prokaryotic production hosts depend on resistance and tolerance properties of the production organisms for efficient production of the desired chemical. For example, many fermentation processes are exothermic and require the removal of heat or cooling of bioreactors to ensure the continued viability and productivity of the organism used for fermentation. Media used for production can have low or high pH values (i.e. pH<5.0 for low pH values, pH>9.0 for high pH values) due to acidic or basic pre-treatment processes that were used for the production of sugars used in the fermentation. Alternatively, media used in fermentation can contain salts (i.e. sodium chloride) resulting from neutralization with bases or acids of the acids and bases used in the pre-treatment processes. Because the growth of many species of microbes, including many yeasts, is inhibited by heat, salt, low pH or high pH, it is often necessary to employ microbes that are naturally tolerant or resistant to these abiotic stresses, or to engineer sensitive strains and species of microbes for higher levels of tolerance or resistance.

Alcohols, such as ethanol, butanol and isobutanol are common products of fermentation processes employing yeasts and other microbes. Alcohols are toxic compounds and can be tolerated by yeasts and other microbes only in limited concentrations. Although some ethanol-producing yeast species are naturally resistant to ethanol (for example *Saccharomyces cerevisiae*), higher ethanol tolerance is generally desirable in ethanol-producing industrial yeast strains to maximize the productivity of fermentation processes. Other alcohols such as butanol are highly toxic at low concentrations, and yeast species that are naturally resistant to these alcohols have not been found. It is therefore broadly desirable to enhance alcohol tolerance in yeast species used for the production of alcohols (Cakar 2012, Doğan 2014).

Furthermore, the feedstocks used in a variety of biological production systems, particularly those feedstocks derived from degradation of plant products, often contain elevated concentrations of salts, acetate, growth-inhibitory carbohydrates, or various toxic organic compounds derived from plant lignins. The ability of a production organism to tolerate the presence of these toxic compounds is a prerequisite for maximal productivities. In addition, the pH found in production systems may be outside the pH optimum for the production organism used, and the organism's ability to grow at pH values outside of its natural optimum may be important in certain production systems.

Renewable biomass, including lignocellulosic material and agricultural residues such as corn fiber, corn stover, corn cob, wheat straw, rice straw, and sugarcane bagasse, are low cost materials for bioethanol production. Dilute acid hydrolysis is commonly used in biomass degradation which hydrolyzes cellulose and hemicellulose fractions to increase fiber porosity to allow enzymatic saccharification and fermentation of the cellulose fraction. (Saha 2003). However, acid hydrolysis both acidifies the resulting mix of sugars and also generates inhibitory compounds that interfere with microbial growth and hinders subsequent fermentation. These compounds include aldehydes (such as furfural, 5-hydroxymethylfurfural, etc.), ketones, phenols, and organic acids (such as acetic, formic, levulinic acids, etc.). Two of the most potent inhibitors are furfural and 5-hydroxymethylfurfrual (5-hydroxymethylfurfrual referred to as "HMF" hereafter). Yeast growth can be reduced by the combination of furfural and HMF at concentrations as low as 5 mM (Liu 2004).

These inhibitors can be removed from the hydrolysate before its use in fermentation, using physical chemical or enzymatic steps and treatments. However, these additional steps add complexity to the production process, produce waste products, and add significantly to the production cost. Alternatively, species or strains of microbes or yeasts need to be used for fermentation that are resistant to inhibitors present in sugars derived from biomass and other sources, resistant to ethanol and other products of the fermentation, and/or tolerant of abiotic stresses such as high temperature, high salt and low pH that are frequently encountered during fermentation processes (Cakar 2012, Doğan 2014). Most yeast strains, including industrial strains, are susceptible to the growth-inhibiting compounds released by dilute acid hydrolysis pre-treatment (Martin 2003). Yet few yeast strains tolerant to inhibitors are available and the need for tolerant strains is well recognized (Klinke 2004, Zaldivar 2001, Nieves 2015).

Genetic or epigenetic changes in organisms can improve the organisms' performance and raise their productivities. Particularly useful is the introduction of nucleic acids that confer dominant traits. This implies that the functions performed by the introduced nucleic acids, whether they encode RNA or protein or perform another function in the cell or organism, alter or overrides the function performed by similar nucleic acids that are naturally present in the cell or organism.

The present disclosure describes 83 fusion polynucleotides that confer resistance and tolerance in *S. cerevisiae* to alcohols and to abiotic stresses such as heat, salt, and low pH. These fusion polynucleotides are generated by pairwise fusion of full length open reading frames present in the *S. cerevisiae* genome. They are useful for improving *S. cerevisiae*, other yeasts, and other production microbes and to raise the productivity of a variety of biological production systems.

BRIEF SUMMARY OF THE INVENTION

The fusion polynucleotides described in the present disclosure were isolated from fusion polynucleotide libraries prepared by fusing pairs of intact *S. cerevisiae* open reading frames precisely and in-frame in a random manner, inserting the pairwise gene fusions into a plasmid vector containing sequences for their propagation in bacteria and in yeast, expressing the fusion polynucleotides in yeast, generating a population of yeast cells harboring these fusion gene constructs, selecting the population for resistance to a variety of products and stresses, including ethanol, butanol, heat, salt and low pH, and recovering the plasmids from cells surviving the selections as set forth in U.S. Ser. No. 14/134,619. The plasmids were then individually tested for their ability to confer alcohol or stress tolerance in yeast. Of the 83 fusion polynucleotides described in the present disclosure, 63 were isolated and tested in this manner (SEQ ID NO: 1-63). Twenty additional fusion polynucleotides (SEQ ID NO: 205-224) were prepared individually and in a targeted manner by combining open reading frames identified among the first 63 fusion polynucleotides with each other, or with additional open reading frames present in the yeast genome, in new sequence combinations.

Among the fusion polynucleotides listed in the disclosure are multiple ones (61 different fusion polynucleotides) containing the yeast WHI2 gene (Saul 1985, Mountain 1990, Mountain 1990a, Radcliffe 1997, Kaida 2002, Leadsham 2009, Mendl 2011, Müller 2011). WHI2 has previously been implicated in stress tolerance (Mendl 2011, Willer 2011) as well as a variety of other cellular processes, including regulation of colony morphology, control of cell division and cell size, nutritional sensing, and mitochondrial function.

Among the fusion polynucleotides listed in the disclosure are two fusion polynucleotides and their corresponding fusion proteins which represent fusions of the WHI2 protein with phosphatases, 14 fusion polynucleotides and their corresponding fusion proteins which represent fusions of the WHI2 protein with members of the KEOPS complex, a conserved protein complex with a role in telomere maintenance, but of largely unknown function (Bianchi 2006, Downey 2006), as well as 11 fusion polynucleotides and their corresponding fusion proteins which represent fusions of the WHI2 protein with members of the EGO complex, a vacuolar membrane-associated protein complex with a role in activation of microautophagy during exit from rapamycin-induced growth arrest (Dubouloz 2005, Gao 2006, Piper 2006).

The present disclosure describes the sequences of these 83 fusion polynucleotides, and their activity for conferring stress and alcohol tolerance.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

FIG. 1—Table 5A: Heat and ethanol resistance and tolerance activities of 19 fusion polynucleotides and their individual constituent ORFs in glucose-containing medium in *S. cerevisiae*.

FIG. 2—Table 5B: Butanol and low pH resistance and tolerance activities of 19 fusion polynucleotides and their individual constituent ORFs in glucose-containing medium in *S. cerevisiae*.

FIG. 3—Table 6A: Heat and ethanol resistance and tolerance activities of 20 KEOPS/EGO fusion polynucleotides and their individual constituent ORFs in glucose-containing medium in *S. cerevisiae*.

FIG. 4—Table 6B: Butanol and low pH resistance and tolerance activities of 20 KEOPS/EGO fusion polynucleotides and their individual constituent ORFs in glucose-containing medium in *S. cerevisiae*.

FIG. 5—Table 7A: Heat, ethanol, butanol, low pH and salt resistance and tolerance activities of 6 fusion polynucleotide GAL1 centromeric plasmids and their corresponding individual ORF GAL1 centromeric plasmids in galactose-containing medium in *S. cerevisiae*.

FIG. 6—Table 7B: Heat, ethanol, butanol, low pH and salt resistance and tolerance activities of 9 fusion polynucleotide GAL1 centromeric plasmids and their corresponding individual ORF GAL1 centromeric plasmids in galactose-containing medium in *S. cerevisiae*.

DETAILED DESCRIPTION OF THE INVENTION

The following abbreviations and definitions will be used for the interpretation of the specification and the claims.

As used herein, the terms "comprises," "comprising," "includes," "including," "has," "having," "contains" or "containing," or any other variation thereof, are intended to cover a non-exclusive inclusion. For example, a composition, a mixture, process, method, article, or apparatus that comprises a list of elements is not necessarily limited to only those elements but may include other elements not expressly listed or inherent to such composition, mixture, process, method, article, or apparatus. Further, unless expressly stated to the contrary, "or" refers to an inclusive or and not to an exclusive or. For example, a condition A or B is satisfied by any one of the following: A is true (or present) and B is false (or not present), A is false (or not present) and B is true (or present), and both A and B are true (or present).

Complementary nucleotide sequence: As used herein, a complementary nucleotide sequence is a sequence in a polynucleotide chain in which all of the bases are able to form base pairs with a sequence of bases in another polynucleotide chain.

Composite open reading frame: As used herein, a composite open reading frame results from the in-frame fusion of at least two different starting open reading frames, resulting in a new open reading frame comprising all starting open reading frames and encoding a fusion protein comprising the sequences encoded by all starting open reading frames Control elements: The term 'control elements' refers to nucleotide sequences located upstream (5' non-coding sequences), within, or downstream (3' non-coding sequences) of a coding sequence and which influence the transcription, RNA processing or stability, or translation of the associated coding sequence. Regulatory sequences may include promoters, translation leader sequences, introns, polyadenylation recognition sequences, RNA processing site, effector binding site and stem-loop structure.

Degenerate Sequence: In this application degenerate sequences are defined as populations of sequences where specific sequence positions differ between different molecules or clones in the population. The sequence differences may be a single nucleotide or multiple nucleotides of any number, examples being 2, 3, 4, 5, 6, 7, 8, 9, 10, 20, 30, 40, 50, 60, 70, 80, 90, 100, 200, 300, 400, 500, 600, 700, 800, 900 or 1000 nucleotides, or any number in between. Sequence differences in a degenerate sequence may involve the presence of 2, 3 or 4 different nucleotides in that position within the population of sequences, molecules or clones. Examples of degenerate nucleotides in a specific position of a sequence are: A or C; A or G; A or T; C or G; C or T; G or T; A, C or G; A, C or T; A, G or T; C, G or T; A, C, G or T.

Discrete Random Polynucleotide: A discrete random polynucleotide refers to a specific polynucleotide within a mixed collection of polynucleotides, chosen randomly from the collection.

Expression: The term "expression", as used herein, refers to the transcription and stable accumulation of sense (mRNA) or antisense RNA derived from the nucleic acid disclosed, as well as the accumulation of polypeptide as a product of translation of mRNA.

Full-length Open Reading Frame: As used herein, a full-length open reading frame refers to an open reading frame encoding a full-length protein which extends from its natural initiation codon to its natural final amino-acid coding codon, as expressed in a cell or organism. In cases where a particular open reading frame sequence gives rise to multiple distinct full-length proteins expressed within a cell or an organism, each open reading frame within this sequence, encoding one of the multiple distinct proteins, can be considered full-length. A full-length open reading frame can be continuous or may be interrupted by introns.

Fusion polynucleotide: A fusion polynucleotide as used in this application refers to a polynucleotide that results from the operable joining of two separate and distinct polynucleotides into a single polynucleotide. In the context of this application, the term in-frame fusion polynucleotide is defined as a fusion polynucleotide encoding a fusion polypeptide.

Fusion polypeptide: A fusion polypeptide is an expression product resulting from the fusion of two or more open reading frames that originally coded for separate proteins.

Gene: The term "gene" refers to a nucleic acid fragment that is capable of being expressed as a specific protein, optionally including regulatory sequences preceding (5' non-coding sequences) and following (3' non-coding sequences) the coding sequence. "Native gene" refers to a gene as found in nature in its natural host organism. "Natural gene" refers to a gene complete with its natural control sequences such as a promoter and terminator. "Chimeric gene" refers to any gene that comprises regulatory and coding sequences that are not found together in nature. Accordingly, a chimeric gene may comprise regulatory sequences and coding sequences that are derived from different sources, or regulatory sequences and coding sequences derived from the same source, but arranged in a manner different than that found in nature. Similarly, a "foreign" gene refers to a gene not normally found in the host organism, but that is introduced into the host organism by gene transfer. Foreign genes can comprise native genes inserted into a non-native organism, or chimeric genes. A "transgene" is a gene that has been introduced into the genome by a transformation procedure.

In-Frame: The term "in-frame" in this application, and particularly in the phrase "in-frame fusion polynucleotide," refers to the reading frame of codons in an upstream or 5' polynucleotide or ORF as being the same as the reading frame of codons in a polynucleotide or ORF placed downstream or 3' of the upstream polynucleotide or ORF that is fused with the upstream or 5' polynucleotide or ORF. Such in-frame fusion polynucleotides typically encode a fusion protein or fusion peptide encoded by both the 5' polynucleotide and the 3' polynucleotide. Collections of such in-frame fusion polynucleotides can vary in the percentage of fusion polynucleotides that contain upstream and downstream polynucleotides that are in-frame with respect to one another. The percentage in the total collection is at least 10% and can number 10%, 11%, 12%, 13%, 14%, 15%, 20%, 25%, 30%, 35%, 40%, 45%, 50%, 55%, 60%, 65%, 70%, 75%, 80%, 85%, 90%, 95%, 96%, 97%, 98%, 99% or 100% or any number in between.

Iterate/Iterative: In this application, to iterate means to apply a method or procedure repeatedly to a material or sample. Typically, the processed, altered or modified material or sample produced from each round of processing, alteration or modification is then used as the starting material for the next round of processing, alteration or modification. Iterative selection refers to a selection process that iterates or repeats the selection two or more times, using the survivors of one round of selection as starting material for the subsequent rounds.

Non-homologous: The term "non-homologous" in this application is defined as having sequence identity at the nucleotide level of less than 50%.

Open Reading Frame (ORF): An ORF is defined as any sequence of nucleotides in a nucleic acid that encodes a protein or peptide as a string of codons in a specific reading frame. Within this specific reading frame, an ORF can contain any codon specifying an amino acid, but does not contain a stop codon. The ORFs in the starting collection need not start or end with any particular amino acid. The ORF may be continuous or may be interrupted by introns.

Operably linked: The term "operably linked" refers to the association of nucleic acid sequences on a single nucleic acid fragment so that the function of one is affected by the other. For example, a promoter is operably linked with a coding sequence when it is capable of effecting the expression of that coding sequence (i.e., that the coding sequence is under the transcriptional control of the promoter). Coding sequences can be operably linked to regulatory sequences in sense or antisense orientation.

Percentage of sequence identity: The term "percent sequence identity" refers to the degree of identity between any given query sequence, e.g. SEQ ID NO: 102, and a subject sequence. A subject sequence typically has a length that is from about 80 percent to 200 percent of the length of the query sequence, e.g., 80, 82, 85, 87, 89, 90, 93, 95, 97, 99, 100, 105, 110, 115, or 120, 130, 140, 150, 160, 170, 180, 190 or 200 percent of the length of the query sequence. A percent identity for any subject nucleic acid or polypeptide relative to a query nucleic acid or polypeptide can be determined as follows. A query sequence (e.g. a nucleic acid or amino acid sequence) is aligned to one or more subject nucleic acid or amino acid sequences using the computer program ClustalW (version 1.83, default parameters), which allows alignments of nucleic acid or protein sequences to be carried out across their entire length (global alignment, Chenna 2003).

ClustalW calculates the best match between a query and one or more subject sequences, and aligns them so that identities, similarities and differences can be determined. Gaps of one or more residues can be inserted into a query sequence, a subject sequence, or both, to maximize sequence alignments. For fast pairwise alignment of nucleic acid sequences, the following default parameters are used: word size: 2; window size: 4; scoring method: percentage; number of top diagonals: 4; and gap penalty: 5. For multiple alignment of nucleic acid sequences, the following parameters are used: gap opening penalty: 10.0; gap extension penalty: 5.0; and weight transitions: yes. For fast pairwise alignment of protein sequences, the following parameters are used: word size: 1; window size: 5; scoring method: percentage; number of top diagonals: 5; gap penalty: 3. For multiple alignment of protein sequences, the following parameters are used: weight matrix: blosum; gap opening penalty: 10.0; gap extension penalty: 0.05; hydrophilic gaps: on; hydrophilic residues: Gly, Pro, Ser, Asn, Asp, Gln, Glu, Arg, and Lys; residue-specific gap penalties: on. The ClustalW output is a sequence alignment that reflects the relationship between sequences. ClustalW can be run, for example, at the Baylor College of Medicine Search Launcher website and at the European Bioinformatics Institute website on the World Wide Web (ebi.ac.uk/clustalw).

To determine a percent identity of a subject or nucleic acid or amino acid sequence to a query sequence, the sequences are aligned using Clustal W, the number of identical matches in the alignment is divided by the query length, and the result is multiplied by 100. It is noted that the percent identity value can be rounded to the nearest tenth. For example, 78.11, 78.12, 78.13, and 78.14 are rounded down to 78.1, while 78.15, 78.16, 78.17, 78.18, and 78.19 are rounded up to 78.2.

Plasmid: The terms "plasmid" and "vector" refer to genetic elements used for carrying genes which are not a natural part of a cell or an organism. Vectors can either integrate into the genome or can be maintained extrachromosomally as linear or circular DNA fragments. Such elements may be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction which is useful for introducing polynucleotide sequences into a cell or an organism.

Phenotypic Value: Phenotypic value refers to a quantitative measure of a phenotype or a trait exhibited by an organism. For example, height measured in feet is a phenotypic value corresponding to body height in humans.

Promoter: The term "promoter" refers to a DNA sequence capable of controlling the expression of a coding sequence or functional RNA. In general, a coding sequence is located 3' to a promoter sequence. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental or physiological conditions. Promoters which cause a gene to be expressed in most cell types at most times are commonly referred to as "constitutive promoters". It is further recognized that since in most cases the exact boundaries of regulatory sequences have not been completely defined, DNA fragments of different lengths may have identical promoter activity.

Random/Randomized: made or chosen without method or conscious decision.

Randomized In-frame Fusion Polynucleotides: As used herein, this phrase refers to polynucleotides in one or more starting populations fused to each other in a random manner to form randomized fusion polynucleotides, each randomized fusion polynucleotide comprising two or more members of the starting population(s). The random nature of the fusion is such that the association between different polynucleotides capable of fusing is not deliberately biased or directed, so that each starting polynucleotide has an equal or similar probability to be represented in the final population of fusion polynucleotides, and that it has an equal or similar probability to be fused with any other member of the starting population(s).

Randomized Translational Fusion: A randomized translational fusion is a process by which polynucleotides are randomly fused in a manner that the ORFs specified by the individual polynucleotide sequences are fused in-frame, to result in a fusion polynucleotide that encodes a fusion protein.

Randomly Fused: The term "randomly fused" refers to a process by which a collection of fused polynucleotides is generated from one or more collections of starting polynucleotides, where each member of the starting polynucleotide collection(s) has an equal or similar probability of joining to each other member. The objective of generating randomly fused polynucleotides is typically to generate all possible combinations, or as many combinations as possible, of fused members or sequences.

Resistance to a compound or stress, as described herein, implies that the cell is able to grow and divide under unfavorable conditions that would normally be inhibitive to growth.

Stringency of selection: The term "stringency of selection" refers to selection intensity, or the degree to which selective conditions affect the probability of an organism surviving the selection. A higher stringency of selection implies a higher selection intensity, with lower survival rates expected; a lower stringency of selection implies a lower selection intensity, with higher survival rates expected. Survival of a particular organism or population of organisms under selection ultimately depends on the fitness or viability of that organism or population of organisms under the selective conditions Tolerance of a compound or stress, as described herein, implies that the cell is able to survive under unfavorable conditions that would normally be lethal to the cell.

Transformed: The term "transformed" means genetic modification by introduction of a polynucleotide sequence.

Transformation: As used herein the term "transformation" refers to the transfer of a nucleic acid fragment into a host organism, resulting in genetically stable inheritance. Host organisms containing the transformed nucleic acid fragments are referred to as "transgenic" or "recombinant" or "transformed" organisms.

Transformed Organism: A transformed organism is an organism that has been genetically altered by introduction of a polynucleotide sequence into the organism's genome.

The term unfavorable conditions as used herein implies any part of the growth condition, physical or chemical, that results in slower growth than under normal growth conditions, or that reduces the viability of cells compared to normal growth conditions.

The sequences of the 83 fusion polynucleotides are given in SEQ ID NO: 1-63 and 205-224; the amino acid sequence of the proteins encoded by the fusion polynucleotides are provided in SEQ ID NO: 64-126 and 225-244. These fusion polynucleotides are useful for developing alcohol and stress resistance and tolerance traits in a target organism. In general, expression of one or more of the fusion polynucleotides described herein can enhance stress and alcohol tolerance in a cell or organism.

Target organisms for the expression and use of the fusion polynucleotides described herein include but are not limited to: baker's yeast *Saccharomyces cerevisiae*; other *Saccharomyces* species; *Schizosaccharomyces pombe*; *Kluyveromyces* species such as *K. lactis*, *K marxianus* and *K. thermotolerans*; *Candida* species such as *C. albicans*, *C. glabrata*, *C. stellate*, *C. tropicalis*, *C. dubliniensis* and *C. keroseneae*; *Pichia* species such as *P. angusta*, *P. anomala*, *P. membranifaciens* and *P. pastoris*; oleaginous yeasts such as *Yarrowia lipolytica*; other yeast species such as *Dekkera/Brettanomyces* species; *Brettanomyces bruxellensis*; *Torulaspora delbrueckii*; *Zygosaccharomyces bailii*; and other yeasts, fungi, microbial eukaryotes and eukaryotic algae.

The 83 fusion polynucleotides described herein confer resistance or tolerance to a variety of stresses and unfavorable conditions, including, but not limited to high temperature; low temperature; low pH; high pH; high salt concentration; high osmotic strength; low osmotic strength; presence of oxidizing agents (hydrogen peroxide and other inorganic peroxides; inorganic oxidizing agents such as potassium permanganate; organic peroxides and hydroperoxides such as ethyl hydroperoxide, diacetyl peroxide, diethyl maleate, tert-butyl hydroperoxide, cumyl hydroperoxide and ascaridole); high pressure; low pressure; ionizing radiation such as ultraviolet, X-ray or gamma irradiation; presence of toxic metal ions such as those derived from the elements Ag (silver), As (arsenic), Cd (cadmium), Cr (chromium), Co (cobalt), Cu (copper), Hg (mercury), Ni (nickel), Pb (lead), Pt (platinum), Sb (antimony), Se (selenium), TI (thallium), or Zn (zinc); high concentrations of alcohols such as ethanol, propanol, iso-propanol, butanol, iso-butanol, alcohols with carbon chains exceeding 4 carbons; high concentrations of alkanes such as butane, pentane, hexane, heptane, octane, nonane, decane, undecane, dodecane, hexadecane, or isomers thereof; presence of furfural, 5-hydroxymethylfurfural, benzoic acid derivatives (for example p-hydroxybenzoic acid), and other toxic lignin breakdown products found in sugar preparations derived from biomass (Luo 2002); or unfavorable conditions or stresses caused by the presence of any other toxic compound or combinations of compounds, or any combination of the above.

In one embodiment, one or more of the fusion polynucleotides is combined with control elements such as a promoter and/or terminator in a manner that the promoter is upstream of the 5' end of the fusion polynucleotide's coding region and the terminator is downstream of the 3' end of the fusion polynucleotide' coding region. If the control elements are selected from such sequences that are known or suspected to be active in the target cell or organism, then the resulting expression constructs, or 'expression cassettes', each consisting of a promoter, a fusion polynucleotide, and a terminator, confer expression of the fusion polynucleotide when introduced into a cell.

Promoters used for expression of fusion polynucleotides may be strong promoters that result in high levels of protein expression, or weak promoters that result in low levels of protein expression, or promoters of intermediate strength. Promoters may also be constitutive, being expressed in all or most cells and in all or most stages of growth, or specific promoters whose activity depends on specific growth states or metabolic states. Inducible promoters, whose activity depends on the presence of a specific chemical or metabolite or growth condition which induces the promoter to be active, or repressible promoters, which can be shut off or reduced in activity in the presence of a specific chemical or metabolite or growth condition are also suitable. For example, a fusion polynucleotide encoding a fusion protein conferring stress tolerance can be expressed using a promoter that is induced under conditions of abiotic stress or in the presence of toxic and growth-inhibiting compounds in the growth medium.

Terminators used for expression of fusion polynucleotides may also vary in their activity. The function of a terminator in gene expression is in completing the transcription process and influencing mRNA half-life. Expression cassettes of fusion polynucleotides may contain strong or weak terminators or terminators of intermediate activity that predispose an mRNA to high, low or intermediate levels of stability. Such terminators are suitable for pairing with strong, weak or intermediate promoters.

The fusion polynucleotide expression cassettes may be further combined with sequences useful for propagation, or for selection of cell clones that have taken up DNA introduced into a population of cells. Such sequences may include, but are not limited to: centromeres, autonomously replicating elements, 2 micron plasmid origins of replication, prototrophic marker genes such as the *S. cerevisiae* genes URA3, TRP1, HIS3 or LEU2, or marker genes conferring resistance to antibiotics such as the kanamycin resistance gene conferring resistance to the aminoglycoside antibiotic G418 and related antibiotics.

Combinations of fusion polynucleotide expression cassettes and one or more sequences useful for propagation in the target organism may be inserted into a plasmid vector and cloned in *E. coli* or another suitable organism that allows propagation and replication of the joined polynucleotide sequences (Sambrook 1989). They may also be joined and then amplified using in vitro amplification methods such as the polymerase chain reaction.

Individual fusion polynucleotide expression cassettes combined with other sequences are then introduced into yeast in a manner that they become stably established as part of the yeast genome. There are a variety of suitable methods or introducing nucleic acids into yeast, including lithium acetate transformation (Gietz 2002, Gietz 2006, Gietz 2007), electroporation, spheroplast transformation, biolistic particle bombardment, and a glass bead method (Gietz 2001, Kawai 2010). Other methods of yeast transformation are also known, including use of 2 micron plasmids, and integrative transformation where the fusion polynucleotide is stably integrated within a yeast chromosome. In *Saccharomyces cerevisiae*, site-specific integration is routine and the integration site is dependent on sequences homologous to chromosomal sites that are present on the integrating nucleic acid.

After introduction into yeast, the population of yeast cells exposed to nucleic acid comprising the polynucleotide expression cassettes many be cultured in a medium allowing isolation of yeast clones that have taken up the polynucleotide expression cassettes and incorporated them into their genome. For example, if a fusion polynucleotide expression cassette is joined to a URA3 selectable marker gene and introduced into a ura-strain of yeast, then the resulting cell population, when plated on solid minimal media lacking uracil, will only allow growth of colonies that have stably taken up the URA3 selectable marker. If the URA3 selectable marker is covalently associated with yeast centromere sequences and a yeast autonomously replicating sequence as well as a fusion polynucleotide expression cassette, then the resulting yeast centromeric plasmid can become established in the yeast genome as a circular mini-chromosome, whose sequences are faithfully inherited during cell division.

In another embodiment, two or more fusion polynucleotides can be introduced into the same cell or organism to cause synergistic effects, and to result in a cell or an organism with higher levels of stress tolerance than observed when using only a single fusion polynucleotide. Such combinations of fusion polynucleotides can also arise in the process of screening a cell or an organism transformed with one or more fusion polynucleotides for enhanced resistance to or tolerance of stresses and toxic compounds by transforming this organism with a library of fusion polynucleotides and screening the resulting transformants for higher levels of resistance or tolerance.

After delivery of a fusion polynucleotide and its control sequences into a cell, and its selection for presence in the cell, a variety of tests for resistance to and tolerance of stresses and toxic compounds are performed, which typically include exposure of a cell population to an unfavorable condition for a specified period of time and monitoring of the cell population during or after exposure. Changes in growth rate or cell viability are measured by comparing transformed cells to untransformed control cells or cells transformed with a control nucleic acid, such as an empty expression vector or a gene known not to confer resistance or tolerance phenotypes.

The fusion polynucleotides described herein can be used with yeast strains used for fermentation or the production of fuels or chemicals. Fermentation and fuel or chemical production often involve culturing the cells in the presence of compounds that inhibit growth, compounds that reduce cell viability, or abiotic conditions including but not limited to high temperature, high salt, low pH or high pH that also either inhibit growth or reduce cell viability or cell productivity or combinations thereof.

The fusion polynucleotides are also useful for modifying industrial yeast strains used for the production of ethanol, other alcohols, or a variety of chemicals.

Among the fusion polynucleotides listed herein are 61 different fusion polynucleotides containing the yeast full length WHI2 open reading frame. The WHI2 gene (Saul 1985, Mountain 1990, Mountain 1990a, Radcliffe 1997, Kaida 2002, Leadsham 2009, Mendl 2011, Müller 2011), has been previously implicated in stress tolerance (Mendl 2011, Müller 2011) as well as a variety of other cellular processes including regulation of colony morphology, control of cell division and cell size, nutritional sensing, and mitochondrial function.

Among the fusion polynucleotides listed herein are two fusion polynucleotides (M21-A09, M24-B12; SEQ ID NO:31 and 44) and their corresponding fusion proteins (SEQ ID NO:94 and 107) which represent fusions of the WHI2 protein with phosphatases.

Among the fusion polynucleotides listed herein are 14 fusion polynucleotides (Y1-38A, SEQ ID NO:15; M22-C05, SEQ ID NO: 35; M23-C03, SEQ ID NO:37; M27-B07, SEQ ID NO: 56; PP0219-223, SEQ ID NOS: 205-209; and PP0229-233, SEQ ID NOS: 215-219) and their corresponding fusion proteins (Y1-38A, SEQ ID NO:78; M22-C05, SEQ ID NO: 98; M23-C03, SEQ ID NO:100; M27-B07, SEQ ID NO: 119; PP0219-223, SEQ ID NOS: 225-229; and PP0229-233, SEQ ID NOS: 235-239) which represent fusions of the WHI2 protein with members of the KEOPS complex, a conserved protein complex with a role in telomere maintenance, but of largely unknown function (Bianchi 2006, Downey 2006).

Among the fusion polynucleotides listed herein are 11 fusion polynucleotides (M21-008, SEQ ID NO: 32; PP0224-228, SEQ ID NOS: 210-214; and PP0234-238, SEQ ID NOS: 220-224) and their corresponding fusion proteins (M21-008, SEQ ID NO: 95; PP0224-228, SEQ ID NOS: 230-234; and PP0234-238, SEQ ID NOS: 240-244) which represent fusions of the WHI2 protein with members of the EGO complex, a vacuolar membrane-associated protein complex with a role in activation of microautophagy during exit from rapamycin-induced growth arrest (Dubouloz 2005, Gao 2006, Piper 2006).

The sequences of 83 fusion polynucleotides are given in SEQ ID NO: 1-63 and 205-224; the sequences of the fusion proteins that they encode are given in SEQ ID NO: 64-126 and 225-244.

Table 1 shows a summary of all 83 fusion polynucleotides and their component ORFs

TABLE 1

Yeast active fusion polynucleotides + component open reading frames (ORFs)

| Fusion poly-nucleotide name | Nucleic acid SEQ ID | Protein SEQ ID | 5' ORF ID | 5' ORF name | 5' ORF description | 3' ORF ID | 3' ORF name | 3' ORF description |
|---|---|---|---|---|---|---|---|---|
| Y1-5A | 1 | 64 | YDR246W-A | | Putative protein of unknown function | YOR043W | WHI2 | Activator of the general stress response |
| Y1-7A | 2 | 65 | YHR126C | ANS1 | Putative protein of unknown function | YOR043W | WHI2 | Activator of the general stress response |
| Y1-9A | 3 | 66 | YOL026C | MIM1 | Mitochondrial outer membrane protein | YDL159W | STE7 | Signal transducing MAP kinase kinase |
| Y1-13A | 4 | 67 | YDR488C | PAC11 | Dynein intermediate chain | YOR043W | WHI2 | Activator of the general stress response |
| Y1-17A | 5 | 68 | YOR043W | WHI2 | Activator of the general stress response | YJL185C | YJL185C | Putative protein of unknown function |
| Y1-18A | 6 | 69 | YLR375W | STP3 | Zinc-finger protein of unknown function | YOR085W | OST3 | Oligosaccharyl-transferase gamma subunit |

TABLE 1-continued

Yeast active fusion polynucleotides + component open reading frames (ORFs)

| Fusion poly-nucleotide name | Nucleic acid SEQ ID | Protein SEQ ID | 5' ORF ID | 5' ORF name | 5' ORF description | 3' ORF ID | 3' ORF name | 3' ORF description |
|---|---|---|---|---|---|---|---|---|
| Y1-19A | 7 | 70 | YOR043W | WHI2 | Activator of the general stress response | YFL066C | YFL066C | Y' element helicase-like protein |
| Y1-20A | 8 | 71 | YHL028W | WSC4 | ER membrane protein involved in translocation | YOR043W | WHI2 | Activator of the general stress response |
| Y1-21A | 9 | 72 | YOL054W | PSH1 | E3 ubiquitin ligase | YLR094C | GIS3 | Protein of unknown function |
| Y1-23A | 10 | 73 | YFL066C | YFL066C | Y' element helicase-like protein | YOR043W | WHI2 | Activator of the general stress response |
| Y1-25A | 11 | 74 | YGR060W | ERG25 | C-4 methyl sterol oxidase | YOR043W | WHI2 | Activator of the general stress response |
| Y1-28A | 12 | 75 | YJL065C | DLS1 | ISW2 chromatin accessibility complex subunit | YOR043W | WHI2 | Activator of the general stress response |
| Y1-33A | 13 | 76 | YLR094C | GIS3 | Protein of unknown function | YKL117W | SBA1 | Hsp90 family co-chaperone |
| Y1-34B | 14 | 77 | YML064C | TEM1 | GTP-binding protein of the ras superfamily | YOR043W | WHI2 | Activator of the general stress response |
| Y1-38A | 15 | 78 | YML036W | CGI121 | Component of the KEOPS protein complex | YOR043W | WHI2 | Activator of the general stress response |
| Y1-39B | 16 | 79 | YLR466C-B | YLR466C-B | Dubious open reading frame | YOR043W | WHI2 | Activator of the general stress response |
| Y1-40A | 17 | 80 | YDL109C | YDL109C | Putative lipase; involved in lipid metabolism | YOR043W | WHI2 | Activator of the general stress response |
| Y1-43A | 18 | 81 | YLR154C-G | YLR154C-G | Putative protein of unknown protein | YOR043W | WHI2 | Activator of the general stress response |
| Y1-45A | 19 | 82 | YIR016W | YIR016W | Putative protein of unknown protein | YOR043W | WHI2 | Activator of the general stress response |
| Y1-47A | 20 | 83 | YER018C | SPC25 | Kinetochore-assoc. Ndc80 complex component | YOR043W | WHI2 | Activator of the general stress response |
| Y1-48A | 21 | 84 | YML116W | ATR1 | Multidrug efflux pump | YOR043W | WHI2 | Activator of the general stress response |
| Y1-49A | 22 | 85 | YLR094C | GIS3 | Protein of unknown function | YHR219W | YHR219W | Putative helicase |
| Y1-58B | 23 | 86 | YDR378C | LSM6 | Lsm (Like Sm) protein | YBL075C | SSA3 | ATPase involved in protein folding, stress response |
| Y1-58C | 24 | 87 | YDR462W | MRPL28 | Mitochondrial large subunit ribosomal protein | YGL236C | MTO1 | Mitochondrial protein |
| Y1-66C | 25 | 88 | YGL235W | YGL235W | Putative protein of unknown function | YLR369W | SSQ1 | Mitochondrial hsp70-type molecular chaperone |
| Y1-67B | 26 | 89 | YLL039C | UBI4 | Ubiquitin essential for the cellular stress response | YBL081W | YBL081W | Non-essential protein of unknown function |
| Y2-28A | 27 | 90 | YLR154C-G | YLR154C-G | Putative protein of unknown function | YOL060C | MAM3 | Protein required for mitochondrial morphology |

TABLE 1-continued

Yeast active fusion polynucleotides + component open reading frames (ORFs)

| Fusion poly-nucleotide name | Nucleic acid SEQ ID | Protein SEQ ID | 5' ORF ID | 5' ORF name | 5' ORF description | 3' ORF ID | 3' ORF name | 3' ORF description |
|---|---|---|---|---|---|---|---|---|
| M21-A02 | 28 | 91 | YOR043W | WHI2 | Activator of the general stress response | YHR203C | RPS4B | 40S ribosomal subunit protein |
| M21-A03 | 29 | 92 | YOR043W | WHI2 | Activator of the general stress response | YLR094C | GIS3 | Protein of unknown function |
| M21-A04 | 30 | 93 | YGR209C | TRX2 | Cytoplasmic thioredoxin isoenzyme | YOR043W | WHI2 | Activator of the general stress response |
| M21-A09 | 31 | 94 | YGR203W | YCH1 | Phosphatase similar to Cdc25p | YOR043W | WHI2 | Activator of the general stress response |
| M21-C08 | 32 | 95 | YBR077C | SLM4 | Component of the EGO protein complex | YOR043W | WHI2 | Activator of the general stress response |
| M21-D06 | 33 | 96 | YNL086W | SNN1 | Putative protein of unknown function | YOR043W | WHI2 | Activator of the general stress response |
| M22-C01 | 34 | 97 | YPR080W | TEF1 | Translational elongation factor EF-1 alpha | YOR043W | WHI2 | Activator of the general stress response |
| M22-005 | 35 | 98 | YKR095W-A | PCC1 | Component of the KEOPS protein complex | YOR043W | WHI2 | Activator of the general stress response |
| M22-D01 | 36 | 99 | YIR015W | RPR2 | Subunit of nuclear RNase P | YOR043W | WHI2 | Activator of the general stress response |
| M23-CO3 | 37 | 100 | YJL184W | GON7 | Component of the KEOPS protein complex | YOR043W | WHI2 | Activator of the general stress response |
| M23-D02 | 38 | 101 | YPL250C | ICY2 | Protein of unknown function | YJL205C | NCE101 | Protein of unknown function |
| M23-D09 | 39 | 102 | YMR226C | YMR226C | NADP(+)-dependent dehydrogenase | YBR195C | MSI1 | Subunit of chromatin assembly factor I |
| M23-E02 | 40 | 103 | YEL034W | HYP2 | Translation elongation factor eIF-5A | YOR043W | WHI2 | Activator of the general stress response |
| M23-F02 | 41 | 104 | YPL250C | ICY2 | Protein of unknown function | YOR043W | WHI2 | Activator of the general stress response |
| M23-H01 | 42 | 105 | YLR154C-G | YLR154C-G | Putative protein of unknown function | YGR063C | SPT4 | Pol I and Pol II transcriptional regulator |
| M24-A05 | 43 | 106 | YNR049C | MSO1 | Secretory vesicle docking complex component | YOR043W | WHI2 | Activator of the general stress response |
| M24-B12 | 44 | 107 | YMR156C | TPP1 | DNA 3'-phosphatase | YOR043W | WHI2 | Activator of the general stress response |
| M24-D11 | 45 | 108 | YBR195C | MSI1 | Subunit of chromatin assembly factor I | YOR101W | RAS1 | G-protein signaling GTPase |
| M24-E05 | 46 | 109 | YGR203W | YCH1 | Phosphatase similar to Cdc25p | YLR094C | GIS3 | Protein of unknown function |
| M24-F06 | 47 | 110 | YHR055C | CUP1-2 | Metallothionein binding copper and cadmium | YOR043W | WHI2 | Activator of the general stress response |
| M25-E1 | 48 | 111 | YJR120W | YJR120W | Protein of unknown function | YOR043W | WHI2 | Activator of the general stress response |
| M25-F4 | 49 | 112 | YHR055C | CUP1-2 | Metallothionein | YOR043W | WHI2 | Activator of the general stress response |
| M25-G8 | 50 | 113 | YPR062W | FCY1 | Cytosine deaminase | YOR043W | WHI2 | Activator of the general stress response |

TABLE 1-continued

Yeast active fusion polynucleotides + component open reading frames (ORFs)

| Fusion poly-nucleotide name | Nucleic acid SEQ ID | Protein SEQ ID | 5' ORF ID | 5' ORF name | 5' ORF description | 3' ORF ID | 3' ORF name | 3' ORF description |
|---|---|---|---|---|---|---|---|---|
| M25-G10 | 51 | 114 | YMR195W | ICY1 | Protein of unknown function | YBR195C | MSI1 | Subunit of chromatin assembly factor I |
| M25-H11 | 52 | 115 | YMR195W | YLR162W | Putative protein of unknown function | YOR043W | WHI2 | Activator of the general stress response |
| M26-Al2 | 53 | 116 | YMR195W | ICY1 | Protein of unknown function | YOR043W | WHI2 | Activator of the general stress response |
| M26-D6 | 54 | 117 | YNL259C | ATX1 | Cytosolic copper metallochaperone | YOR043W | WHI2 | Activator of the general stress response |
| M27-A1 | 55 | 118 | YDR432W | NPL3 | RNA-binding protein | YOR043W | WHI2 | Activator of the general stress response |
| M27-B7 | 56 | 119 | YOR043W | WHI2 | Activator of the general stress response | YML036W | CGI121 | Component of the KEOPS protein complex |
| M27-F8 | 57 | 120 | YDR24 | YDR246W-A | Putative protein of unknown function | YHR008C | S0D2 | Mitochondrial manganese superoxide dismutase |
| M28-A4 | 58 | 121 | YER018C | SPC25 | Kinetochore-assoc. Ndc80 complex component | YNL042W-B | YNL042W-B | Putative protein of unknown function |
| M28-C9 | 59 | 122 | YDR246W-A | YDR246W-A | Putative protein of unknown function | YPL157W | TGS1 | Trimethyl guanosine synthase |
| M28-D6 | 60 | 123 | YBR197C | YBR197C | Putative protein of unknown function | YLR094C | GIS3 | Protein of unknown function |
| M28-E4 | 61 | 124 | YDR378C | LSM6 | Lsm (Like Sm) protein | YLR094C | GIS3 | Protein of unknown function |
| M29-E7 | 62 | 125 | YGR063C | SPT4 | Pol I and Pol II transcriptional regulator | YOR043W | WHI2 | Activator of the general stress response |
| M30-E11 | 63 | 126 | YLR044C | PDC1 | Pyruvate decarboxylase | YIL033C | BCY1 | cAMP-dep protein kinase regulatory subunit |
| PP0219 | 205 | 225 | YGR262C | BUD32 | Component of the KEOPS protein complex | YOR043W | WHI2 | Activator of the general stress response |
| PP0220 | 206 | 226 | YJL184 | GON7 | Component of the KEOPS protein complex | YOR043W | WHI2 | Activator of the general stress response |
| PP0221 | 207 | 227 | YKR038C | KAE1 | Component of the KEOPS protein complex | YOR043W | WHI2 | Activator of the general stress response |
| PP0222 | 208 | 228 | YKR095W-A | PCC1 | Component of the KEOPS protein complex | YOR043W | WHI2 | Activator of the general stress response |
| PP0223 | 209 | 229 | YML036W | CGI121 | Component of the KEOPS protein complex | YOR043W | WHI2 | Activator of the general stress response |
| PP0224 | 210 | 230 | YBR077C | SLM4 | Component of the KEOPS protein complex | YOR043W | WHI2 | Activator of the general stress response |

TABLE 1-continued

Yeast active fusion polynucleotides + component open reading frames (ORFs)

| Fusion poly-nucleotide name | Nucleic acid SEQ ID | Protein SEQ ID | 5' ORF ID | 5' ORF name | 5' ORF description | 3' ORF ID | 3' ORF name | 3' ORF description |
|---|---|---|---|---|---|---|---|---|
| PP0225 | 211 | 231 | YGR163W | GTR2 | Component of the KEOPS protein complex | YOR043W | WHI2 | Activator of the general stress response |
| PP0226 | 212 | 232 | YKL143W | LTV1 | Component of the EGO protein complex | YOR043W | WHI2 | Activator of the general stress response |
| PP0227 | 213 | 233 | YKR007W | MEH1 | Component of the EGO protein complex | YOR043W | WHI2 | Activator of the general stress response |
| PP0228 | 214 | 234 | YML121W | GTR1 | Component of the EGO protein complex | YOR043W | WHI2 | Activator of the general stress response |
| PP0229 | 215 | 235 | YOR043W | WHI2 | Activator of the general stress response | YGR262C | BUD32 | Component of the KEOPS protein complex |
| PP0230 | 216 | 236 | YOR043W | WHI2 | Activator of the general stress response | YJL184W | GON7 | Component of the KEOPS protein complex |
| PP0231 | 217 | 237 | YOR043W | WHI2 | Activator of the general stress response | YKR038C | KAE1 | Component of the KEOPS protein complex |
| PP0232 | 218 | 238 | YOR043W | WHI2 | Activator of the general stress response | YKR095W-A | PCC1 | Component of the KEOPS protein complex |
| PP0233 | 219 | 239 | YOR043W | WHI2 | Activator of the general stress response | YML036W | CGI121 | Component of the KEOPS protein complex |
| PP0234 | 220 | 240 | YOR043W | WHI2 | Activator of the general stress response | YBR077C | SLM4 | Component of the EGO protein complex |
| PP0235 | 221 | 241 | YOR043W | WHI2 | Activator of the general stress response | YGR163W | GTR2 | Component of the EGO protein complex |
| PP0236 | 222 | 242 | YOR043W | WHI2 | Activator of the general stress response | YKL143W | LTV1 | Component of the EGO protein complex |
| PP0237 | 223 | 243 | YOR043W | WHI2 | Activator of the general stress response | YKR007W | MEH1 | Component of the EGO protein complex |
| PP0238 | 224 | 244 | YOR043W | WHI2 | Activator of the general stress response | YML121W | GTR1 | Component of the EG + A2:I85 |

EXAMPLES

Example 1: Generation of Fusion Polynucleotides Encoding Fusion Polypeptides A yeast fusion polynucleotide library was generated according to the method set forth in U.S. application Ser. No. 14/134,619, which is hereby incorporated by reference in its entirety.

Example 2: Resistance and Tolerance Phenotypes in Galactose-Containing Media of Yeast Strains Transformed with Fusion Polynucleotide Centromeric Plasmids All fusion polynucleotides generated from Example 1 were cloned into a derivative of the yeast centromeric plasmid p416-GAL1 (Mumberg 1995, Funk 2002). The yeast centromeric plasmid p416-GAL1 contains the following sequences for plasmid propagation in yeast and/or E. coli and expression of an inserted polynucleotide: the bacterial replicon of plasmid pMB1, the bacterial ampicillin-resistance gene, the yeast CEN6/ARSH4 cassette (Sikorski 1989) containing the chromosome 6 centromere and the yeast histone H4-associated autonomously replicating sequence (ARS), the yeast URA3 prototrophic marker gene, and the yeast GAL1 promoter and CYC1 terminator placed adjacent to each other in a manner that allows expression of coding regions inserted therebetween. The nucleotide sequence of the p416-GAL1 derivative is SEQ ID NO 127. All polynucleotides were cloned between nucleotide numbers 3206 and 3207 of SEQ ID NO 127.

The resulting set of centromeric plasmids containing expression cassettes of the 63 fusion polynucleotides under control of the S. cerevisiae GAL1 promoter (SEQ ID NO: 1-63) are hereafter referred to as 'fusion polynucleotide GAL1 centromeric plasmids'. Individual fusion polynucleotide GAL1 centromeric plasmids are referred to by the SEQ ID number of the fusion polynucleotide contained therein, i.e. 'fusion polynucleotide GAL1 centromeric plasmid #5' corresponds to SEQ ID NO: 5 cloned between nucleotide numbers 3206 and 3207 of the p416-GAL1 vector (SEQ ID NO 127).

All experiments measuring tolerance and resistance activities of the fusion polynucleotides were performed using strain BY4741 (Brachmann 1998) transformed with each fusion polynucleotide GAL1 centromeric plasmid.

Yeast transformations were performed by the lithium acetate-heat shock method (Gietz 2002, Gietz 2006, Gietz 2007). The yeast strain BY4741 (Brachmann 1998) from a plate or an overnight culture was inoculated into 50 ml of YPD medium (for 1 L medium, 20 g Bacto Peptone, 10 g Bacto Yeast Extract are combined and after autoclaving 20 g Glucose are added as a 20% sterile solution) at 30° C. on a shaker at 225 rpm from a starting density of $5 \times 10^6$ cells/ml (cell density determined with a hemocytometer), and grown over several hours to a final cell density of $2 \times 10^7$ cells/ml. The cells were harvested by centrifuging at 3000 g for 5 min, were then resuspended in 25 ml of sterile deionized water, and centrifuged again. Cells were resuspended in 1 ml of sterile water, transferred to a 1.5 ml microcentrifuge tube, centrifuged for 30 sec at 3000 rpm and the supernatant aspirated. The cell pellet was then resuspended in 0.4 ml of sterile deionized water. The cell suspension was combined with 3.26 ml of transformation mix (2.4 ml of 50% w/v PEG 3350, 360 µl 1M Lithium acetate and 500 µl 10 mg/ml sheared, boiled salmon sperm DNA) and mixed well. Aliquots of DNA (100 ng-1 µg) were pipetted into separate 1.5 ml microcentrifuge tubes and combined with 380 µl of the cell suspension in transformation mix. The cell/DNA mixture was mixed thoroughly and incubated at 42° C. on a shaker at 250 rpm for 40 minutes. The transformations were then centrifuged for 1 minute at 3000 rpm in a microcentrifuge, the supernatant aspirated and each cell aliquot resuspended in 0.5-1 ml sterile deionized water. Depending on the desired density of colonies, 10 µl to 1 ml of the cell suspension were plated with sterile 4 mm glass beads onto one 10 cm or 15 cm plate containing synthetic complete uracil dropout solid medium having glucose as a carbon source (SCD-Ura agar; for 1 L, 6.7 g yeast nitrogen base, 0.77 g uracil dropout mix and 15 g Bacto agar are combined, the pH is adjusted with 120 µl 10N NaOH to bring the pH to 5.6-5.8, and after autoclaving 20 g glucose are added as a 20% sterile solution). After drying, the plates were covered and incubated at 30° C. for 3-4 days until colonies of transformants had formed. The individual fusion polynucleotide GAL1 centromeric plasmid transformants of strain BY4741 were maintained on SCD-Ura agar.

Resistance to and tolerance of the 64 yeast strains containing fusion polynucleotides (63 fusion polynucleotide GAL1 centromeric plasmids and one control vector) to heat (42° C.), ethanol (15%), butanol (3%), salt (2M NaCl) and low pH (pH 3.0 in 0.2M sodium acetate) were measured in triplicate.

The 64 strains were first cultured for 16 hours at 30° C., 800 rpm with a 3 mm radius of gyration in 96-well plates (2 ml square wells) in synthetic complete uracil dropout medium containing glucose and galactose as carbon sources (SCDGal-Ura; for 1 L of medium, 6.7 g yeast nitrogen base, 0.77 g uracil dropout mix, and 5 g glucose are combined, the pH is adjusted to 5.6-5.8 by the addition of 120 µl 10N NaOH and after autoclaving 5 g glucose and 15 g galactose are added as sterile 20% solutions). The cell density was then measured with a hemocytometer, and the cells diluted in fresh 96-well plates (2 ml square wells) to a final cell density of $1 \times 10^7$ cells/ml in 1.25 ml YPGal (for 1 L of medium, 20 g Bacto Peptone and 10 g Bacto Yeast Extract are combined, and after autoclaving 20 g galactose are added as a sterile 20% solution). The cells were cultured for an additional 5 hours.

The cell suspensions were then added in 0.25 ml aliquots to new 96-well plates (2 ml square wells), each well containing 0.25 ml of YPGal medium with a 2x concentration of one selective agent. The selective agents used were: NaCl at a final concentration of 2M; ethanol at a final concentration of 15%; n-butanol at a final concentration of 3%; or sodium acetate pH 3.0 at a final concentration of 0.2M. The sodium acetate was prepared as a 1M solution of sodium acetate pH 3.0 by mixing 2.74 ml glacial acetic acid with 0.11 g anhydrous sodium acetate in 50 ml final volume and filter sterilized using a 0.2 micron filter. For measuring heat tolerance, the 0.25 ml aliquots of cell suspension were combined with 0.25 ml of YPGal and cultured in 96-well plates (2 ml square wells) at 42° C. All selective cultures were incubated for 3 days: those measuring heat tolerance at 42° C. and all others at 30° C. The cultures were then spotted undiluted and in 1:10 dilutions onto fresh 15 cm plates containing YPD solid medium (for 1 L medium, 20 g Bacto Peptone, 10 g Bacto Yeast Extract and 15 g Bacto Agar are combined, and after autoclaving 20 g glucose are added as a sterile 20% solution). Spotting was conducted using a Bel-Art 96-well replicating tool (Bel-Art Products) that deposits spots of approximately 3 µl from each well onto the recipient plate. Dilutions were made in synthetic complete uracil dropout medium containing glucose as a carbon source (SCD-Ura; for 1 L of medium, 6.7 g yeast nitrogen base and 0.77 g uracil dropout mix are combined, the pH is adjusted to 5.6-5.8 by the addition of 120 µl 1 ON NaOH and after autoclaving 20 g glucose are added as a sterile 20% solution).

The spots were allowed to dry, the plates incubated at 30° C. for 1 day to allow surviving cells to grow into cell spots or individual colonies. The cell density of surviving cells from each transformant for each selective condition was scored on a relative scale from 0-3, 0 being no growth, 1 being slight growth, 2 being significant growth and 3 being confluent growth. Both the undiluted and diluted spots were taken into account to generate the score. Triplicate measurements were made for each condition and control.

To obtain a final activity score for each fusion polynucleotide GAL1 centromeric plasmid and each selective condition, the triplicate scores for each selective condition were added, and the triplicate score for the control plasmid subtracted. Final activity scores below zero were scored as zero. All scores are shown in Table 2 under the columns labeled 'Activity scores (rich medium)'.

Resistance and tolerance of the 64 yeast strains to ethanol and butanol were also measured in minimal media containing raffinose and galactose as carbon sources. Here, the 64 strains were first grown in 96 well plates (2 ml square wells) containing minimal uracil dropout medium containing 2% raffinose as a carbon source (SCRaf-Ura; for 1 L of medium, 6.7 g yeast nitrogen base and 0.77 g uracil dropout mix are combined; pH is adjusted to 5.6-5.8 by the addition of 120 µl 10N NaOH and after autoclaving 20 g raffinose are added as a sterile 20% solution). Cells were incubated for 6 hours at 30° C. with constant shaking at 200 rpm. Expression of the fusion genes was then induced with galactose at a final concentration of 2% and incubation continued overnight. Subsequently, 0.1 OD cultures from each well were inoculated into minimal uracil dropout medium containing 1% raffinose and 2% galactose containing different concentrations of ethanol and butanol. Four concentrations each of ethanol (i.e. 8%, 11%, 14% and 17% v/v) and n-butanol (2%, 2.5%, 3% and 3.5% v/v) were used.

The 96-well culture plates (2 ml square wells) were covered with air-permeable sealing films and all plates were together further sealed in a large airtight plastic bag. This created a semi-aerobic condition and the cultures were incubated in a shaking incubator at 30° C. for 3 days. Using a Bel-Art 96-well replicating tool (Bel-Art Products) two dilutions of each culture (1:10 and 1:100) were spotted on minimal uracil dropout solid medium containing glucose as a carbon source (SCD-Ura agar; for 1 L of medium, 6.7 g yeast nitrogen base, 0.77 g uracil dropout mix, and 15 g Bacto Agar are combined, the pH is adjusted to 5.6-5.8 by the addition of 120 µl 10N NaOH and after autoclaving 20 g glucose are added as a sterile 20% solution). The plates were incubated at 30° C. for 2 days.

An image was taken of each plate and was scored for each dilution for each fusion polynucleotide. A score of 0 to 5 was given to each spot based on growth compared to the negative control strain. For each fusion polynucleotide GAL1 centromeric plasmid and for each dilution, the score was multiplied by its corresponding concentration of butanol/ethanol and averaged. The same scoring method was followed for the strain with the negative control plasmid on the same plates: this provided the background. The final score was obtained by subtracting the average score of the negative control strain from the average score of the strain with the individual fusion polynucleotide GAL1 centromeric plasmids. All scores are shown in Table 2 under the columns labeled 'Activity scores (minimal medium)'.

Yeast strain BY4741, when transformed with each of the 63 fusion polynucleotide GAL1 centromeric plasmids, showed significant resistance to or tolerance of elevated temperature, ethanol, butanol, low pH and/or high salt compared to the negative control plasmid p416-GAL1, as shown in Table 2 below.

All resistance and tolerance scores above background are listed in Table 2 below.

TABLE 2

Resistance and tolerance activities of 63 fusion polynucleotides in galactose-containing rich medium in *S. cerevisiae*

| Fusion polynucleotide name | Fusion gene nucleic acid sequence SEQ ID | Fusion gene protein sequence SEQ ID | Activity scores (rich medium) | | | | | Activity scores (minimal medium) | |
|---|---|---|---|---|---|---|---|---|---|
| | | | Heat (42° C.) | Ethanol (15%) | Butanol (3%) | pH 3 (0.1M sodium acetate) | Salt (2M NaCl) | Butanol (3%) | Ethanol (15%) |
| Y1-5A | 1 | 64 | 3.75 | 0.00 | 4.75 | 2.75 | 4.75 | 0.0 | 35.0 |
| Y1-7A | 2 | 65 | 3.75 | 1.75 | 7.75 | 7.75 | 7.75 | 0.0 | 3.5 |
| Y1-9A | 3 | 66 | 0.00 | 1.75 | 4.75 | 4.75 | 4.75 | 0.0 | 0.8 |
| Y1-13A | 4 | 67 | 5.75 | 2.75 | 10.75 | 6.75 | 6.75 | 0.0 | 10.5 |
| Y1-17A | 5 | 68 | 6.75 | 2.75 | 7.75 | 8.75 | 7.75 | 0.0 | 7.0 |
| Y1-18A | 6 | 69 | 0.00 | 0.00 | 1.75 | 2.75 | 3.75 | 0.0 | 0.0 |
| Y1-19A | 7 | 70 | 0.75 | 5.75 | 7.75 | 8.75 | 7.75 | 0.0 | 9.8 |
| Y1-20A | 8 | 71 | 6.75 | 0.00 | 3.75 | 2.75 | 2.75 | 0.0 | 23.8 |
| Y1-21A | 9 | 72 | 5.75 | 0.00 | 4.75 | 5.75 | 7.75 | 0.0 | 0.0 |
| Y1-23A | 10 | 73 | 6.75 | 0.00 | 4.75 | 5.75 | 4.75 | 0.0 | 0.8 |
| Y1-25A | 11 | 74 | 0.75 | 0.00 | 1.75 | 2.75 | 1.75 | 0.0 | 7.0 |
| Y1-28A | 12 | 75 | 3.75 | 2.75 | 5.75 | 7.75 | 6.75 | 0.0 | 17.5 |
| Y1-33A | 13 | 76 | 6.75 | 0.00 | 0.00 | 1.75 | 4.75 | 0.0 | 0.0 |
| Y1-34B | 14 | 77 | 6.75 | 5.75 | 7.75 | 8.75 | 7.75 | 0.0 | 14.0 |
| Y1-38A | 15 | 78 | 6.75 | 2.75 | 7.75 | 8.75 | 4.75 | 0.0 | 7.0 |
| Y1-39B | 16 | 79 | 6.75 | 3.75 | 7.75 | 6.75 | 5.75 | 0.0 | 14.0 |
| Y1-40A | 17 | 80 | 5.75 | 0.00 | 1.75 | 5.75 | 4.75 | 0.0 | 7.0 |
| Y1-43A | 18 | 81 | 6.75 | 5.75 | 6.75 | 8.75 | 7.75 | 0.0 | 14.0 |

TABLE 2-continued

Resistance and tolerance activities of 63 fusion polynucleotides in galactose-containing rich medium in S. cerevisiae

| Fusion polynucleotide name | Fusion gene nucleic acid sequence SEQ ID | Fusion gene protein sequence SEQ ID | Activity scores (rich medium) | | | | | Activity scores (minimal medium) | |
|---|---|---|---|---|---|---|---|---|---|
| | | | Heat (42° C.) | Ethanol (15%) | Butanol (3%) | pH 3 (0.1M sodium acetate) | Salt (2M NaCl) | Butanol (3%) | Ethanol (15%) |
| Y1-45A | 19 | 82 | 6.75 | 0.00 | 0.00 | 0.00 | 1.75 | 0.0 | 0.0 |
| Y1-47A | 20 | 83 | 8.75 | 5.75 | 4.75 | 4.75 | 4.75 | 0.0 | 14.8 |
| Y1-48A | 21 | 84 | 6.75 | 5.75 | 4.75 | 8.75 | 7.75 | 0.0 | 10.5 |
| Y1-49A | 22 | 85 | 1.75 | 0.00 | 0.00 | 0.00 | 1.75 | 0.0 | 0.0 |
| Y1-58B | 23 | 86 | 0.00 | 0.00 | 0.00 | 0.00 | 0.00 | 0.0 | 0.0 |
| Y1-58C | 24 | 87 | 0.00 | 0.00 | 0.00 | 0.00 | 0.00 | 0.0 | 0.0 |
| Y1-66C | 25 | 88 | 0.00 | 0.00 | 0.00 | 0.00 | 0.00 | 0.0 | 0.0 |
| Y1-67B | 26 | 89 | 0.75 | 0.00 | 0.00 | 0.00 | 2.75 | 3.0 | 0.0 |
| Y2-28A | 27 | 90 | 0.75 | 0.00 | 0.00 | 0.00 | 0.00 | 0.0 | 0.0 |
| M21-A02 | 28 | 91 | 3.75 | 2.75 | 4.75 | 7.25 | 7.75 | 4.5 | 0.0 |
| M21-A03 | 29 | 92 | 6.75 | 5.75 | 10.75 | 11.75 | 7.75 | 16.0 | 0.0 |
| M21-A04 | 30 | 93 | 6.75 | 0.00 | 4.75 | 5.75 | 4.75 | 4.5 | 0.0 |
| M21-A09 | 31 | 94 | 5.75 | 2.75 | 4.75 | 4.75 | 3.75 | 4.5 | 2.8 |
| M21-C08 | 32 | 95 | 6.75 | 2.75 | 6.25 | 5.75 | 4.75 | 4.5 | 2.8 |
| M21-D06 | 33 | 96 | 7.75 | 0.00 | 4.00 | 3.25 | 9.75 | 1.0 | 0.0 |
| M22-C01 | 34 | 97 | 6.75 | 3.00 | 7.00 | 9.25 | 9.75 | 16.4 | 0.0 |
| M22-C05 | 35 | 98 | 6.75 | 3.00 | 8.00 | 6.25 | 6.75 | 2.5 | 0.0 |
| M22-D01 | 36 | 99 | 4.75 | 3.00 | 7.00 | 6.25 | 9.75 | 3.0 | 0.0 |
| M23-C03 | 37 | 100 | 9.75 | 9.00 | 10.00 | 9.25 | 9.75 | 11.8 | 0.0 |
| M23-D02 | 38 | 101 | 0.00 | 0.00 | 0.00 | 3.25 | 6.75 | 0.0 | 0.0 |
| M23-D09 | 39 | 102 | 0.00 | 9.00 | 10.00 | 12.25 | 12.75 | 6.5 | 0.0 |
| M23-E02 | 40 | 103 | 9.75 | 1.00 | 5.00 | 6.25 | 6.75 | 3.5 | 0.0 |
| M23-F02 | 41 | 104 | 9.75 | 9.00 | 10.00 | 12.25 | 12.75 | 1.6 | 0.8 |
| M23-H01 | 42 | 105 | 2.75 | 0.00 | 3.00 | 6.25 | 6.75 | 0.0 | 0.0 |
| M24-A05 | 43 | 106 | 0.75 | 3.00 | 7.00 | 6.25 | 9.75 | 3.5 | 13.0 |
| M24-B12 | 44 | 107 | 3.75 | 0.00 | 3.00 | 6.25 | 9.75 | 4.5 | 4.3 |
| M24-D11 | 45 | 108 | 0.00 | 3.00 | 10.00 | 6.25 | 3.75 | 18.3 | 0.0 |
| M24-E05 | 46 | 109 | 0.00 | 6.00 | 7.00 | 12.25 | 12.75 | 14.9 | 0.0 |
| M24-F06 | 47 | 110 | 6.75 | 6.00 | 7.00 | 9.25 | 9.75 | 7.8 | 0.0 |
| M25-E1 | 48 | 111 | 9.75 | 3.00 | 4.00 | 6.25 | 9.75 | 4.0 | 0.0 |
| M25-F4 | 49 | 112 | 9.75 | 0.00 | 0.00 | 6.25 | 6.75 | 2.5 | 0.0 |
| M25-G8 | 50 | 113 | 9.75 | 0.00 | 1.00 | 6.25 | 6.75 | 2.5 | 0.0 |
| M25-G10 | 51 | 114 | 1.75 | 6.00 | 1.00 | 8.25 | 8.75 | 0.0 | 0.0 |
| M25-H11 | 52 | 115 | 6.75 | 0.00 | 0.00 | 1.25 | 4.75 | 2.5 | 0.0 |
| M26-A12 | 53 | 116 | 9.75 | 9.00 | 10.00 | 12.25 | 12.75 | 19.1 | 14.3 |
| M26-D6 | 54 | 117 | 9.75 | 0.00 | 0.00 | 6.25 | 5.75 | 20.0 | 17.8 |
| M27-A1 | 55 | 118 | 6.75 | 9.00 | 4.00 | 12.25 | 12.75 | 20.0 | 21.3 |
| M27-B7 | 56 | 119 | 9.75 | 0.00 | 1.00 | 6.25 | 6.75 | 5.6 | 0.0 |
| M27-F8 | 57 | 120 | 0.00 | 0.00 | 0.00 | 0.00 | 0.75 | 0.8 | 0.0 |
| M28-A4 | 58 | 121 | 0.00 | 0.00 | 0.00 | 0.00 | 3.75 | 0.0 | 0.0 |
| M28-C9 | 59 | 122 | 0.00 | 0.00 | 0.00 | 0.00 | 6.75 | 0.0 | 0.0 |
| M28-D6 | 60 | 123 | 3.75 | 0.00 | 4.00 | 6.25 | 9.75 | 2.5 | 0.0 |
| M28-E4 | 61 | 124 | 3.75 | 3.00 | 4.00 | 9.25 | 12.75 | 0.0 | 0.0 |
| M29-E7 | 62 | 125 | 6.75 | 3.00 | 7.00 | 9.25 | 7.75 | 4.4 | 7.0 |
| M30-E11 | 63 | 126 | 0.75 | 0.00 | 0.00 | 0.25 | 8.25 | 13.0 | 0.0 |
| p416-GAL1 | | | 0.00 | 0.00 | 0.00 | 0.00 | 0.00 | 0.0 | 0.0 |

Example 3: Resistance and Tolerance Phenotypes in Glucose-Containing Media of Yeast Strains Transformed with Fusion Polynucleotide Centromeric Plasmids 63 fusion polynucleotides (SEQ ID NO: 1-63) were cloned into the yeast expression vector p466-TEF1 (SEQ ID NO: 128), which is similar to the yeast centromeric plasmid p416-TEF1 (Mumberg 1995, Funk 2002). The yeast centromeric plasmid p466-TEF1 contains the following sequences for plasmid propagation in yeast and E. coli, and expression of an inserted polynucleotide: the bacterial replicon of plasmid pMB1; the bacterial ampicillin-resistance gene; the yeast CEN6/ARSH4 cassette (Sikorski 1989) containing the chromosome 6 centromere and the yeast histone H4-associated autonomously replicating sequence (ARS); the yeast URA3 prototrophic marker gene; and the yeast TEF1 promoter placed adjacent to the CYC1 terminator in a manner that allows expression of coding regions placed between them. All polynucleotides were cloned between nucleotides 3029 and 3030 of SEQ ID NO 128.

The resulting set of constructs are referred to as 'fusion polynucleotide TEF1 centromeric plasmids'. Each contains an expression cassette of one of 63 fusion polynucleotides (SEQ ID NO: 1-63) under control of the S. cerevisiae TEF1 promoter. All experiments measuring tolerance and resistance activities of the fusion polynucleotides were performed by using strain BY4741 (Brachmann 1998) that was transformed with each fusion polynucleotide centromeric plasmid. Yeast transformations were performed using the lithium acetate-heat shock method as described in Example 2. The individual fusion polynucleotide centromeric plasmid transformants of strain BY4741 were maintained on minimal uracil dropout solid medium containing glucose as a carbon source (SCD-Ura agar; for 1 L medium, 6.7 g yeast nitrogen base, 0.77 g uracil dropout mix, and 15 g Bacto Agar are combined, the pH is adjusted to 5.6-5.8 with 120 µl 10N NaOH and after autoclaving 20 g of glucose are added as a sterile 20% solution). Quantitative determinations of ethanol and butanol tolerance was conducted in rich medium containing glucose as a carbon source. Individual fusion polynucleotide centromeric plasmids are referred to by the SEQ ID number of the fusion polynucleotide contained therein, i.e. 'fusion polynucleotide TEF1 centromeric plasmid #5' corresponds to SEQ ID NO 5 cloned between nucleotide numbers 3029 and 3030 of the p466-TEF1 vector.

Resistance and tolerance of the 64 yeast strains (63 harboring the fusion polynucleotide constructs plus one strain with the control vector) were tested for resistance and tolerance to heat (42° C.), ethanol (15%), butanol (3%) and low pH (pH 3.0 in 0.2M sodium acetate). Measurements were taken in quadruplicate; that is, two independent transformants of each fusion polynucleotide centromeric plasmids were each tested in duplicate. Here, the 63 fusion polynucleotide strains and one control strain were first cultured in 96-well plates (2 ml square wells) having 1 ml per well of synthetic complete uracil dropout medium containing glucose as a carbon source (SCD-Ura: for 1 L of medium, 6.7 g yeast nitrogen base and 0.77 g uracil dropout mix are combined, the pH is adjusted to 5.6-5.8 by the addition of 120 µl 10N NaOH, and after autoclaving 20 g glucose are added as a sterile 20% solution). Cells were incubated for 16 hours at 30° C. with shaking at 800 rpm with a 3 mm radius of gyration.

The cell densities were measured with a hemocytometer, the cell suspensions diluted in a fresh 96-well plate (2 ml square wells) to a final cell density of $1 \times 10^7$ cells/ml in 1.25 ml SCD-Ura, and then grown for an additional 2 hours under the same conditions. The cell suspensions were then added in 0.25 ml aliquots to fresh 96-well plates (2 ml square wells) and each aliquot combined with 0.25 ml YPD medium (for 1 L of medium, 20 g Bacto Peptone and 10 g Bacto Yeast Extract are combined, and after autoclaving 20 g glucose are added as a sterile 20% solution) containing a 2× concentration of one selective agent. The selective agents used were: ethanol at a final concentration of 15%; n-butanol at a final concentration of 3%, or sodium acetate pH 3.0 at a final concentration of 0.2M. The sodium acetate was prepared as a 1M solution by mixing 2.74 ml glacial acetic acid with 0.11 g anhydrous sodium acetate in 50 ml final volume and filter sterilized using a 0.2 micron filter. For measuring heat tolerance, the 0.25 ml aliquots of cell suspension were combined with 0.25 ml of SCD-Ura medium and cultured in 96-well plates (2 ml square wells) at 42° C. All selective cultures were incubated for 48 hours; those measuring heat tolerance at 42° C. and all others at 30° C.

Using a Bel-Art 96-well replicating tool (Bel-Art Products) the cultures were then spotted undiluted or as a 1:10 dilution (diluted in SCD-Ura) onto fresh 15 cm plates containing YPD solid medium (for 1 L of medium, 20 g Bacto Peptone, 10 g Bacto Yeast Extract and 15 g Bacto Agar are combined, and after autoclaving 20 g glucose are added as a sterile 20% solution). Approximately 3 µl from each well was deposited onto the recipient plate. The spots were allowed to dry and the plates were incubated at 30° C. for 1 day to allow surviving cells to grow into cell spots or individual colonies. The cell density of each transformant for each selective condition was scored on a relative scale from 0-3; 0 being no growth, 1 slight growth, 2 significant growth, and 3 confluent growth. Both the undiluted and diluted spots were taken into account to generate the score. To obtain a final activity score for each fusion polynucleotide TEF1 centromeric plasmid under each selective condition, the quadruplicate scores for each selective condition obtained for the control plasmid were summed and then subtracted from the sum of the scores obtained with the fusion polynucleotide TEF1 centromeric plasmids. Final activity scores below zero were scored as zero. A cumulative score was calculated by adding the individual activity scores for each fusion polynucleotide TEF1 centromeric plasmid. All scores are shown in Table 3 under the columns labeled 'Activity scores'.

Yeast strain BY4741 transformed with the set of 63 fusion polynucleotide TEF1 centromeric plasmids showed significant resistance to or tolerance of elevated temperature, ethanol, butanol, and/or low pH compared to the negative control plasmid p466-TEF1, as shown in Table 3 below.

Activity scores above background of the 63 fusion polynucleotide TEF1 centromeric plasmids are shown in Table 3 below.

TABLE 3

Resistance and tolerance activities of 63 fusion polynucleotides in glucose-containing rich medium in *S. cerevisiae*

| Fusion poly-nucleotide name | Fusion polynucleotide nucleic acid SEQ ID | Fusion poly-nucleotide protein SEQ ID | Activity scores | | | | |
|---|---|---|---|---|---|---|---|
| | | | Heat (42° C.) | Ethanol (15%) | Butanol (3%) | pH 3 (0.1M sodium acetate) | Cumulative score |
| Y1-5A | 1 | 64 | 1.5 | 4.5 | 3.0 | 6.0 | 15.0 |
| Y1-7A | 2 | 65 | 0.0 | 2.0 | 1.0 | 4.0 | 7.0 |
| Y1-9A | 3 | 66 | 0.0 | 0.0 | 0.0 | 0.0 | 0.0 |
| Y1-13A | 4 | 67 | 1.0 | 5.0 | 3.0 | 6.0 | 15.0 |
| Y1-17A | 5 | 68 | 0.0 | 3.0 | 1.0 | 4.0 | 8.0 |
| Y1-18A | 6 | 69 | 0.0 | 0.0 | 0.0 | 0.0 | 0.0 |
| Y1-19A | 7 | 70 | 2.0 | 4.0 | 3.0 | 6.0 | 15.0 |
| Y1-20A | 8 | 71 | 0.0 | 4.0 | 1.0 | 5.0 | 10.0 |
| Y1-21A | 9 | 72 | 0.0 | 1.0 | 1.0 | 2.0 | 4.0 |
| Y1-23A | 10 | 73 | 0.0 | 2.0 | 0.0 | 4.0 | 6.0 |

TABLE 3-continued

Resistance and tolerance activities of 63 fusion polynucleotides in glucose-containing rich medium in *S. cerevisiae*

| Fusion poly-nucleotide name | Fusion poly-nucleotide nucleic acid SEQ ID | Fusion poly-nucleotide protein SEQ ID | Activity scores | | | | |
|---|---|---|---|---|---|---|---|
| | | | Heat (42° C.) | Ethanol (15%) | Butanol (3%) | pH 3 (0.1M sodium acetate) | Cumulative score |
| Y1-25A | 11 | 74 | 0.0 | 0.0 | 0.0 | 0.0 | 0.0 |
| Y1-28A | 12 | 75 | 0.0 | 4.0 | 1.5 | 6.0 | 11.5 |
| Y1-33A | 13 | 76 | 0.0 | 0.0 | 0.0 | 0.5 | 0.5 |
| Y1-34B | 14 | 77 | 1.0 | 4.0 | 1.5 | 5.5 | 12.0 |
| Y1-38A | 15 | 78 | 1.0 | 4.0 | 1.0 | 6.0 | 12.0 |
| Y1-39B | 16 | 79 | 1.0 | 4.0 | 2.0 | 6.0 | 13.0 |
| Y1-40A | 17 | 80 | 1.0 | 4.0 | 2.0 | 6.0 | 13.0 |
| Y1-43A | 18 | 81 | 2.5 | 4.0 | 2.5 | 6.0 | 15.0 |
| Y1-45A | 19 | 82 | 0.0 | 2.0 | 1.0 | 4.0 | 7.0 |
| Y1-47A | 20 | 83 | 1.0 | 3.0 | 1.0 | 6.0 | 11.0 |
| Y1-48A | 21 | 84 | 0.0 | 3.0 | 1.0 | 6.0 | 10.0 |
| Y1-49A | 22 | 85 | 0.0 | 0.0 | 0.0 | 0.0 | 0.0 |
| Y1-58B | 23 | 86 | 0.0 | 0.0 | 0.0 | 0.5 | 0.5 |
| Y1-58C | 24 | 87 | 0.0 | 0.0 | 0.0 | 0.0 | 0.0 |
| Y1-66 | 25 | 88 | 0.0 | 0.0 | 0.0 | 0.0 | 0.0 |
| Y1-67B | 26 | 89 | 0.0 | 0.0 | 0.0 | 0.0 | 0.0 |
| Y2-28A | 27 | 90 | 0.0 | 0.0 | 0.0 | 0.0 | 0.0 |
| M21-A02 | 28 | 91 | 2.0 | 4.0 | 2.0 | 6.0 | 14.0 |
| M21-A03 | 29 | 92 | 5.0 | 5.5 | 5.0 | 6.0 | 21.5 |
| M21-A04 | 30 | 93 | 2.0 | 4.5 | 2.5 | 6.0 | 15.0 |
| M21-A09 | 31 | 94 | 1.5 | 3.5 | 2.0 | 5.5 | 12.5 |
| M21-C08 | 32 | 95 | 3.0 | 6.0 | 2.0 | 7.0 | 18.0 |
| M21-D06 | 33 | 96 | 0.0 | 4.0 | 3.0 | 6.0 | 13.0 |
| M22-C01 | 34 | 97 | 0.0 | 6.0 | 5.0 | 6.0 | 17.0 |
| M22-C05 | 35 | 98 | 0.0 | 4.0 | 3.0 | 6.0 | 13.0 |
| M22-D01 | 36 | 99 | 2.0 | 4.0 | 3.0 | 6.0 | 15.0 |
| M23-C03 | 37 | 100 | 4.0 | 6.0 | 6.0 | 6.0 | 22.0 |
| M23-D02 | 38 | 101 | 0.0 | 1.0 | 0.5 | 2.5 | 4.0 |
| M23-D09 | 39 | 102 | 0.5 | 5.0 | 2.0 | 6.0 | 13.5 |
| M23-E02 | 40 | 103 | 0.0 | 5.0 | 3.0 | 6.0 | 14.0 |
| M23-F02 | 41 | 104 | 3.5 | 6.0 | 4.0 | 6.0 | 19.5 |
| M23-H01 | 42 | 105 | 0.0 | 0.0 | 0.0 | 0.0 | 0.0 |
| M24-A05 | 43 | 106 | 2.0 | 5.0 | 4.0 | 6.0 | 17.0 |
| M24-B12 | 44 | 107 | 0.5 | 4.0 | 3.5 | 6.0 | 14.0 |
| M24-D11 | 45 | 108 | 0.0 | 0.0 | 0.0 | 0.0 | 0.0 |
| M24-E05 | 46 | 109 | 0.0 | 3.0 | 3.0 | 4.0 | 10.0 |
| M24-F06 | 47 | 110 | 2.0 | 6.0 | 5.0 | 6.0 | 19.0 |
| M25-E01 | 48 | 111 | 0.0 | 3.0 | 1.0 | 4.0 | 8.0 |
| M25-F04 | 49 | 112 | 0.0 | 4.0 | 2.0 | 6.0 | 12.0 |
| M25-G08 | 50 | 113 | 0.0 | 4.0 | 3.0 | 6.0 | 13.0 |
| M25-G10 | 51 | 114 | 0.0 | 1.0 | 0.0 | 2.0 | 3.0 |
| M25-H11 | 52 | 115 | 0.0 | 1.5 | 0.0 | 3.0 | 4.5 |
| M26-A12 | 53 | 116 | 0.0 | 0.0 | 0.0 | 0.0 | 0.0 |
| M26-D06 | 54 | 117 | 0.0 | 4.0 | 2.0 | 6.0 | 12.0 |
| M27-A01 | 55 | 118 | 0.5 | 2.0 | 2.0 | 4.0 | 8.5 |
| M27-B07 | 56 | 119 | 0.5 | 5.5 | 4.5 | 6.0 | 16.5 |
| M27-F08 | 57 | 120 | 0.0 | 0.0 | 0.0 | 0.0 | 0.0 |
| M28-A04 | 58 | 121 | 0.0 | 0.0 | 0.0 | 0.0 | 0.0 |
| M28-C09 | 59 | 122 | 0.0 | 0.0 | 0.0 | 0.0 | 0.0 |
| M28-D06 | 60 | 123 | 0.0 | 3.0 | 3.0 | 5.5 | 11.5 |
| M28-E04 | 61 | 124 | 0.0 | 3.0 | 3.5 | 5.0 | 11.5 |
| M29-E07 | 62 | 125 | 0.5 | 6.0 | 5.0 | 6.0 | 17.5 |
| M30-E11 | 63 | 126 | 0.0 | 0.0 | 1.0 | 0.0 | 1.0 |
| p466-TEF1 | — | — | 0.0 | 0.0 | 0.0 | 0.0 | 0.0 |

Example 4: Quantitative Resistance and Tolerance Phenotypes in Galactose-Containing Media of Yeast Strains Transformed with Fusion Polynucleotide Centromeric Plasmids Eighteen (18) selected fusion polynucleotide GAL1 centromeric plasmids from Example 2 were used to generate quantitative measurements of ethanol and butanol resistance and tolerance activity.

All experiments measuring tolerance and resistance activities were performed by using strain BY4741 (Brachmann 1998) transformed with each fusion polynucleotide GAL1 centromeric plasmid. Yeast transformations were performed using the lithium acetate-heat shock method as described in Example 2. Four independent transformants of each fusion polynucleotide GAL1 centromeric plasmid were tested. The individual fusion polynucleotide GAL1 centromeric plasmid transformants of strain BY4741 were maintained on minimal uracil dropout solid medium containing glucose as a carbon source (SCD-Ura agar; for 1 L medium, 6.7 g yeast nitrogen base, 0.77 g uracil dropout mix, and 15 g Bacto Agar are combined, the pH is adjusted to 5.6-5.8 with 120 µl 1 ON NaOH and after autoclaving 20 g of glucose are added as a sterile 20% solution).

Yeast strains transformed with the 18 fusion polynucleotide GAL1 centromeric plasmids, as well as the p416-GAL1 control plasmid, were tested for resistance and tolerance to ethanol and butanol in minimal media containing raffinose and galactose as carbon sources. The strains were first grown in 96-well plates (2 ml square wells) containing minimal uracil dropout medium containing 2% raffinose as a carbon source (SCRaf-Ura: for 1 L of medium, 6.7 g yeast nitrogen base and 0.77 g uracil dropout mix are combined, the pH is adjusted to 5.6-5.8 by the addition of 120 µl 10N NaOH and after autoclaving 20 g raffinose are added as a sterile 20% solution). Cells were incubated for 16 hours at 30° C. with constant shaking at 800 rpm.

The cell densities were then measured with a hemocytometer, and the cell suspensions diluted to a final cell density of $1\times10^7$ cells/ml in 1.25 rich medium containing raffinose and galactose as carbon sources (YPRaf-Gal; for 1 L of medium: 20 g Bacto Peptone and 10 g Bacto Yeast Extract are combined, and after autoclaving 20 g of raffinose and 20 g of galactose are added as sterile 20% solutions). Cells were cultured for an additional 4 hours at 30° C. with constant shaking at 800 rpm.

The cell suspensions were then added in 0.25 ml aliquots to fresh 96-well plates (2 ml square wells) and combined with 0.25 ml per well of fresh YPRaf-Gal containing a 2× concentration of one selective agent. The selective agents used were: ethanol at a final concentration of 15% and n-butanol at a final concentration of 3%. All selective cultures were incubated for 2 days at 30° C. with constant shaking at 800 rpm.

The cultures were then diluted 1:10 and 1:100 in minimal uracil dropout medium containing glucose as a carbon source (SCD-Ura; for 1 L medium, 6.7 g yeast nitrogen base and 0.77 g uracil dropout mix are combined, the pH is adjusted to 5.6-5.8 by the addition of 120 µl 10N NaOH and after autoclaving 20 g of glucose are added as a sterile 20% solution). 100 µl aliquots of the undiluted and diluted cells were plated onto 10 cm plates containing solid minimal uracil dropout medium containing glucose as a carbon source (SCD-Ura agar; for 1 L medium, 6.7 g yeast nitrogen base, 0.77 g uracil dropout mix and 20 g Bacto Peptone are combined, the pH is adjusted to 5.6-5.8 by the addition of 120 µl 10N NaOH and after autoclaving 20 g of glucose are added as a sterile 20% solution). The plates were allowed to dry and were incubated at 30° C. for 2 days to allow surviving cells to grow into colonies. Colonies were counted on each plate, and the average number of surviving cells and the standard deviation (Std Dev) for each set of transformants were computed. The results are shown in Table 4 under the column labeled 'Number of surviving cells'. The number of starting cells in each culture was approximately $2.5\times10^6$.

From the numbers of surviving cells shown in Table 4 it is clear that yeast strain BY4741 transformed with the 18 fusion polynucleotide GAL1 centromeric plasmids showed significant resistance to or tolerance of ethanol and butanol, compared to the negative control plasmid p466-GAL1.

All surviving cell numbers are listed in Table 4 below.

TABLE 4

Butanol and ethanol resistance and tolerance activities of 18 fusion polynucleotides in galactose-containing rich medium in *S. cerevisiae*

| Fusion poly- nucleotide name | Fusion poly- nucleotide nucleic acid SEQ ID | Fusion poly- nucleotide protein SEQ ID | Number of surviving cells | | | |
|---|---|---|---|---|---|---|
| | | | 3% Butanol | | 15% ethanol | |
| | | | Mean | Std Dev. | Mean | Std Dev. |
| Y1-9A | 3 | 66 | 3,525 | 222 | 52,500 | 6,245 |
| Y1-17A | 5 | 68 | 9,600 | 294 | 165,500 | 21,315 |
| Y1-20A | 8 | 71 | 14,925 | 704 | 100,500 | 8,426 |
| Y1-21A | 9 | 72 | 4,550 | 289 | 4,475 | 834 |
| Y1-23A | 10 | 73 | 8,525 | 457 | 16,025 | 1,090 |
| Y1-28A | 12 | 75 | 7,400 | 455 | 26,400 | 7,189 |
| Y1-33A | 13 | 76 | 1,900 | 392 | 9,575 | 1,962 |
| Y1-34B | 14 | 77 | 19,300 | 883 | 17,025 | 954 |
| Y1-48A | 21 | 84 | 7,800 | 440 | 17,425 | 2,645 |
| Y1-66C | 25 | 88 | 1,875 | 330 | 18,675 | 2,012 |
| M21-A09 | 31 | 94 | 17,500 | 606 | 28,700 | 2,706 |
| M23-D02 | 38 | 101 | 1,575 | 403 | 15,100 | 1,158 |
| M23-H01 | 42 | 105 | 2,350 | 129 | 650 | 129 |
| M24-E05 | 46 | 109 | 9,225 | 1,195 | 14,725 | 1,480 |
| M25-E01 | 48 | 111 | 12,550 | 480 | 60,250 | 17,727 |
| M26-A12 | 53 | 116 | 188,750 | 7,890 | 382,750 | 20,982 |
| M26-D06 | 54 | 117 | 13,625 | 377 | 7,650 | 1,287 |
| M27-A01 | 55 | 118 | 19,250 | 656 | 21,625 | 1,834 |
| p416-GAL1 | 127 | — | 375 | 126 | 575 | 222 |

Example 5: Comparison of Resistance and Tolerance Phenotypes Conferred by Fusion Polynucleotides and Individual ORFs in Glucose-Containing Medium Nineteen (19) selected fusion polynucleotide TEF1 centromeric plasmids from example 3 were used to generate quantitative measurements of heat, ethanol, butanol and low pH resistance and tolerance activity. The 19 fusion polynucleotides were compared in their activity to the 19 individual full length open reading frames (ORFs) that were the building blocks of the fusion polynucleotides.

The 19 fusion polynucleotides and the 19 individual ORFs were cloned into the yeast expression vector p466-TEF1 (SEQ. ID No 128). The yeast centromeric plasmid p466-TEF1 contains the following sequences for plasmid propagation in yeast and E. coli, and for expression of an inserted polynucleotide: the bacterial replicon of plasmid pMB1; the bacterial ampicillin-resistance gene; the yeast CEN6/ARSH4 cassette (Sikorski 1989) which contains the chromosome 6 centromere as well as the yeast histone H4-associated autonomously replicating sequence (ARS); the yeast URA3 prototrophic marker gene; and the yeast TEF1 promoter placed adjacent the CYC1 terminator in a manner that allows expression of coding regions placed between them (see SEQ ID NO:128). All polynucleotides were cloned between nucleotides 3029 and 3030 of SEQ ID NO 128. The 19 fusion polynucleotides cloned into p466-TEF1 are referred to as 'fusion polynucleotide TEF1 centromeric plasmids' and the 19 individual full length open reading frames cloned into p466-TEF1 are referred to as 'individual ORF TEF1 centromeric plasmids', and collectively as 'TEF1 centromeric plasmids' below.

All experiments measuring tolerance and resistance activities were performed using strain BY4741 (Brachmann 1998) that was transformed with each of the 19 fusion polynucleotide TEF1 centromeric plasmids and the 19 individual ORF TEF1 centromeric plasmids, as well as the p466-TEF1 control vector. Yeast transformations were performed using the lithium acetate-heat shock method as described in Example 2. Four independent transformants of each TEF1 centromeric plasmid were tested. The BY4741 transformants were maintained on minimal uracil dropout solid medium containing glucose as a carbon source (SCD-Ura agar; for 1 L medium, 6.7 g yeast nitrogen base, 0.77 g uracil dropout mix, and 15 g Bacto Agar are combined, the pH is adjusted to 5.6-5.8 with 120 µl 10N NaOH and after autoclaving 20 g of glucose are added as a sterile 20% solution).

Resistance and tolerance of the 39 transformed yeast strains to heat (42° C.), ethanol (15%), butanol (3%) and low pH (pH 3.0 in 0.2M sodium acetate) were measured in quadruplicate by testing four independent transformants of each construct. The 39 strains were first cultured in 96-well plates (2 ml square wells) in 1 ml per well of synthetic complete uracil dropout medium containing glucose as a carbon source (SCD-Ura; for 1 L medium, 6.7 g yeast nitrogen base, and 0.77 g uracil dropout mix are combined, the pH is adjusted to 5.6-5.8 by the addition of 120 µl 10N NaOH and after autoclaving 20 g of glucose are added as a sterile 20% solution). Cells were incubated for 16 hours at 30° C. shaking at 800 rpm with a 3 mm radius of gyration.

The cell densities were measured with a hemocytometer, the cell suspensions diluted in a fresh 96-well plate (2 ml square wells) to a final cell density of $1 \times 10^7$ cells/ml in 1.25 ml SCD-Ura, and then grown for an additional 2 hours. The cell suspensions were then added in 0.25 ml aliquots to fresh 96-well plates (2 ml square wells) and combined with 0.25 ml per well of fresh SCD-Ura medium containing 2× concentration of one selective agent. The selective agents used were: ethanol at a final concentration of 15%, n-butanol at a final concentration of 3%, or sodium acetate pH3.0 at a final concentration of 0.2M. The sodium acetate was prepared as a 1M solution of sodium acetate pH 3.0 by mixing 2.74 ml glacial acetic acid with 0.11 g anhydrous sodium acetate in a final volume of 50 ml and filter sterilized using a 0.2 micron filter. For measuring heat tolerance, the 0.25 ml aliquots of cell suspension were combined with 0.25 ml of SCD-Ura medium and cultured in 96-well plates (2 ml square wells) at 42° C. All selective cultures were cultured for 48 hours with constant shaking at 800 rpm; those measuring heat tolerance were incubated at 42° C. and all others at 30° C.

The cultures were then diluted 1:100 and 1:500 in SCD-Ura. 150 µl aliquots of the diluted cells were plated onto 10 cm plates containing solid minimal uracil dropout medium containing glucose as a carbon source (SCD-Ura agar; for 1 L medium, 6.7 g yeast nitrogen base, 0.77 g uracil dropout mix, and 15 g Bacto Agar are combined, the pH is adjusted to 5.6-5.8 using 120 µl 10N NaOH, and after autoclaving 20 g glucose are added as a sterile 20% solution). The plates were allowed to dry and were incubated at 30° C. for 2 days to allow surviving cells to grow into colonies. Colonies were counted on each plate, and the average number of surviving cells and the standard deviations (Std Dev) from each set of transformants computed. Results are shown in Table 5 (FIGS. 1 and 2) under the columns labeled 'Number of surviving cells'. The number of starting cells in each culture was approximately $2.5 \times 10^6$.

Yeast strain BY4741 transformed with various fusion polynucleotide TEF1 centromeric plasmids showed enhanced resistance to or tolerance of heat, ethanol, butanol and low pH, compared to the individual ORF TEF1 centromeric plasmids, as shown in Table 5. Yeast strain BY4741 containing the negative control plasmid p466-TEF1 (SEQ ID NO 128) served as a control.

Only one of the individual ORFs (WHI2) showed any stress tolerance activity; all the others had no measurable activity. Activities of the fusion polynucleotides that surpass the individual WHI2 ORF score are identified by grey shaded cells in Table 5 (FIGS. 1 and 2). In many cases, the activity level is significantly above that of the individual WHI2 ORF, suggesting unexpected gain-of-function activity by the fusion polynucleotides.

All resistance and tolerance scores are listed in Table 5 which is split into two parts; part A (FIG. 1) shows cell counts from heat and ethanol selections and part B (FIG. 2) shows cell counts from butanol and low pH selections.

Example 6: Comparison of Resistance and Tolerance Phenotypes Conferred by KEOPS/EGO Fusion Polynucleotides and Individual ORFs in Glucose-Containing Medium Examples 2, 3 and 5 contain evidence that members of the yeast KEOPS and EGO protein complexes, when fused with the yeast WHI2 ORF, result in elevated levels of stress and alcohol tolerance in yeast strains expressing these fusion proteins (see data for fusion polynucleotides Y1-38A, M22-C05, M23-C03, M27-B07, and M21-008 in Tables 2, 3, and 5.

Both the KEOPS complex and the EGO complex contain 5 different proteins. The members of the KEOPS complex are named BUD32, GON7, KAE1, PCC1 and CGI121. The members of the EGO complex are named SLM4, LTV1, MEH1, GTR1 and GTR2.

To test whether all members of the KEOPS and EGO complexes are able to confer stress and alcohol tolerance when fused with WHI2, 20 new fusions were constructed that combined all 10 members of the two complexes with WHI2 in both orientations. That is, each complex member was present in the fusion polypeptide in the 5' position relative to WHI2 as well as in the 3' position. The 20 resulting fusion polynucleotides (PP0219-PP0238; SEQ ID NOs 205-224, respectively, whose protein sequences are given in SEQ ID NOs 225-244, respectively) were cloned into the yeast expression vector p466-TEF1 (SEQ. ID No 128); see example 3 for details. The resulting 20 new fusion polynucleotide constructs are referred to as the 'KEOPS/ EGO TEF1 fusion polynucleotide centromeric plasmids'. Each of the 11 full-length ORFs (BUD32, GON7, KAE1, PCC1, CGI121, SLM4, LTV1, MEH1, GTR1, GTR2 and WHI2) were also individually cloned into yeast expression vector p466-TEF1 (SEQ. ID No 128); see example 3 for details. The resulting 11 new individual full length ORF constructs are referred to as the 'KEOPS/EGO TEF1 individual ORF centromeric plasmids'. All centromeric expression constructs discussed in this example are collectively referred to as 'TEF1 centromeric plasmids'.

The 20 KEOPS/EGO TEF1 fusion polynucleotide centromeric plasmids and the 11 KEOPS/EGO TEF1 individual ORF centromeric plasmids were used to generate quantitative measurements of heat, ethanol, butanol and low pH resistance/tolerance activity. The 20 fusion polynucleotides were compared in their activity to the 11 individual ORFs that are the building blocks of the 20 fusion polynucleotides.

All experiments measuring tolerance and resistance activities were performed using strain BY4741 (Brachmann 1998) transformed with each of the 20 KEOPS/EGO TEF1 fusion polynucleotide centromeric plasmids and the 11 KEOPS/EGO TEF1 individual ORF centromeric plasmids, as well as the p466-TEF1 control vector. Yeast transformations were performed using the lithium acetate-heat shock method as described in Example 2. Four independent transformants of each TEF1 centromeric plasmid were tested. The BY4741 transformants were maintained on minimal uracil dropout solid medium containing glucose as a carbon source (SCD-Ura agar; for 1 L medium, 6.7 g yeast nitrogen base, 0.77 g uracil dropout mix, and 15 g Bacto Agar are combined, the pH is adjusted to 5.6-5.8 with 120 µl 10N NaOH and after autoclaving 20 g of glucose are added as a sterile 20% solution).

Resistance and tolerance of the 32 yeast strains (BY4741 transformed with 20 KEOPS/EGO TEF1 fusion polynucleotide centromeric plasmids, 11 KEOPS/EGO TEF1 individual ORF centromeric plasmids and one control vector) to heat (42° C.), ethanol (15%), butanol (3%) and low pH (pH 3.0 in 0.2M sodium acetate) were measured in quadruplicate by testing four independent transformants of each construct. The 32 strains were first cultured in 96-well plates (2 ml square wells) in 1 ml per well of synthetic complete uracil dropout medium containing glucose as a carbon source (SCD-Ura; for 1 L medium, 6.7 g yeast nitrogen base and 0.77 g uracil dropout mix are combined, the pH is adjusted to 5.6-5.8 with 120 µl 10N NaOH, and after autoclaving 20 g of glucose are added as a sterile 20% solution). The cells were incubated for 16 hours at 30° C. with constant shaking at 800 rpm with a 3 mm radius of gyration.

The cell densities were measured with a hemocytometer, the cell suspensions diluted in a fresh 96-well plate (2 ml square wells) to a final cell density of $1\times10^7$ cells/ml in 1.25 ml SCD-Ura, and then grown for an additional 2 hours. The cell suspensions were added in 0.25 ml aliquots to fresh 96-well plates (2 ml square wells) and combined with 0.25 ml per well of fresh SCD-Ura medium containing a 2× concentration of one selective agent. The selective agents used were: ethanol at a final concentration of 15%; n-butanol at a final concentration of n-butanol or sodium acetate pH3.0 at a final concentration of 0.2M. The sodium acetate was prepared as a 1M solution of sodium acetate pH 3.0 by mixing 2.74 ml glacial acetic acid with 0.11 g anhydrous sodium acetate in 50 ml final volume and filter sterilized using a 0.2 micron filter. For measuring heat tolerance, the 0.25 ml aliquots of cell suspension were combined with 0.25 ml of SCD-Ura medium and incubated in 96-well plates (2 ml square wells) at 42° C. All selective cultures were incubated for 72 hours: those measuring heat tolerance at 42° C. and all others at 30° C., with the exception of the butanol selections which were cultured for 48 hours. All selective cultures were incubated with constant shaking at 800 rpm.

The cultures were then diluted 1:100 and 1:500 in SCD-Ura. 150 µl aliquots of the diluted cells were plated onto 10 cm plates containing solid minimal uracil dropout medium containing glucose as a carbon source (SCD-Ura agar; for 1 L medium, 6.7 g yeast nitrogen base, 0.77 g uracil dropout mix and 15 g Bacto Agar are combined, the pH is adjusted to 5.6-5.8 with 120 µl 10N NaOH, and after autoclaving 20 g of glucose are added as a sterile 20% solution). The plates were allowed to dry and were incubated at 30° C. for 2 days to allow surviving cells to grow into colonies. Colonies were counted on each plate, and the average number of surviving cells and their standard deviations (Std Dev) from each set of transformants were computed. Results are shown in Table 6 (FIGS. 3 and 4) under the columns labeled 'Number of surviving cells'. The number of starting cells in each culture was approximately $2.5\times10^6$.

Yeast strain BY4741 transformed with various KEOPS/ EGO TEF1 fusion polynucleotide centromeric plasmids showed enhanced resistance to or tolerance of heat, ethanol, butanol and low pH, compared to the KEOPS/EGO TEF1 individual ORF centromeric plasmids, as shown in Table 6 (FIGS. 3 and 4). Yeast strain BY4741 containing the negative control plasmid p466-TEF1 (SEQ ID NO 128) served as a control.

Only one of the individual full length ORFs (WHI2) showed any stress tolerance activity and all the others had no measurable activity. Activities of the fusion polynucleotides that surpass the WHI2 score are identified by grey shaded cells in Table 6 (FIGS. 3 and 4). In many cases, the activity level is significantly above that of the individual full length WHI2 ORF, suggesting unexpected gain-of-function activity by the fusion polynucleotide. Furthermore, the table shows that each component of the KEOPS complex, and each component of the EGO complex, led to enhanced activity of WHI2 in at least one fusion polynucleotide and phenotypic measurement, suggesting that all members of one complex are able to interact positively with the activity of WHI2 in a fusion protein and/or cause unexpected gain-of-function tolerance or resistance activity when fused with WHI2.

All resistance and tolerance scores are listed in Table 6 which is split into two parts; part A (FIG. 3) shows cell counts from heat and ethanol selections and part B (FIG. 4) shows cell counts from the butanol and low pH selections.

Example 7: Comparison of Resistance and Tolerance Phenotypes Conferred by Fusion Polynucleotides and Individual ORFs in Galactose-Containing Medium Fourteen selected fusion polynucleotide GAL1 centromeric plasmids from Example 2 were used to generate quantitative measurements for heat, ethanol, butanol and low pH resistance and/or tolerance activity. The 14 fusion polynucleotides were compared in their activity to the 14 individual full length ORFs that are the building blocks of the fusion polynucleotides.

The 14 fusion polynucleotides and the 14 individual ORFs were cloned into a derivative of the yeast centromeric plasmid p416-GAL1 (Mumberg 1995, Funk 2002). The yeast centromeric plasmid p416-GAL1 contains the following sequences for plasmid propagation in yeast and E. coli, and expression of an inserted polynucleotide: the bacterial replicon of plasmid pMB1; the bacterial ampicillin-resistance gene; the yeast CEN6/ARSH4 cassette (Sikorski 1989) containing the chromosome 6 centromere and the yeast histone H4-associated autonomously replicating sequence (ARS); the yeast URA3 prototrophic marker gene; and the yeast GAL1 promoter placed adjacent to the CYC1 terminator in a manner that allows expression of coding regions placed between them (see SEQ ID NO: 127). All polynucleotides were cloned between nucleotides 3206 and 3207 of SEQ ID NO 127.

The resulting set of centromeric plasmids containing expression cassettes of the 14 fusion polynucleotides are hereafter referred to as the 'fusion polynucleotide GAL1 centromeric plasmids;' the centromeric plasmids containing expression cassettes of the 14 individual ORFs are hereafter referred to as the 'individual ORF GAL1 centromeric plasmids'. Collectively, the expression constructs are referred to as the 'GAL1 centromeric plasmids'.

All experiments measuring tolerance and resistance activities of the GAL1 centromeric plasmids were performed using strain BY4741 (Brachmann 1998) transformed with each GAL1 centromeric plasmid. Yeast transformations were performed using the lithium acetate-heat shock method as described in Example 2. The GAL1 centromeric plasmid transformants of strain BY4741 were maintained on minimal uracil dropout solid medium containing glucose as a carbon source (SCD-Ura agar; for 1 L medium, 6.7 g yeast nitrogen base, 0.77 g uracil dropout mix, and 15 g Bacto Agar are combined, the pH is adjusted to 5.6-5.8 with 120 µl 10N NaOH and after autoclaving 20 g of glucose are added as a sterile 20% solution).

Resistance and/or tolerance phenotypes for heat (42° C.), ethanol (15%), butanol (3%), low pH (pH 3.0 in 0.2M sodium acetate) and salt (2M NaCl) were measured in triplicate for the 12 yeast strains shown in Table 7A (FIG. 5) with three independent transformants of yeast strain BY4741 with each GAL1 centromeric plasmid. The 13 strains were first cultured in 96-well plates (2 ml square wells) in synthetic complete uracil dropout medium containing glucose as a carbon source (SCD-Ura; for 1 L medium, 6.7 g yeast nitrogen base and 0.77 g uracil dropout mix are combined, the pH is adjusted to 5.6-5.8 with 120 µl 10N NaOH, and after autoclaving 20 g of glucose are added as a sterile 20% solution). Cells were incubated for 16 hours at 30° C. with constant shaking at 800 rpm with a 3 mm radius of gyration.

The cell densities were measured with a hemocytometer and the cell suspensions diluted to a final cell density of $1 \times 10^7$ cells/ml in 1.25 ml rich medium containing galactose as a carbon source (YPGal; for 1 L medium, 20 g Bacto Peptone and 10 g Bacto Yeast Extract are combined and after autoclaving 20 g of galactose are added as a sterile 20% solution). The diluted cultures were incubated for an additional 5 hours under the same conditions. The cell suspensions were then added in 0.25 ml aliquots to fresh 96-well plates (2 ml square wells) and combined with 0.25 ml per well of fresh YPGal containing a 2x concentration of one selective agent. The selective agents used were: NaCl at a final concentration of 2M (salt selection); ethanol at a final concentration of 15%; n-butanol at a final concentration of 3%; or sodium acetate pH 3.0 at a final concentration of 0.2M. The sodium acetate was prepared as a 1M solution of sodium acetate pH 3.0 by mixing 2.74 ml glacial acetic acid with 0.11 g anhydrous sodium acetate in 50 ml final volume and filter sterilized using a 0.2 micron filter. For measuring heat tolerance, the 0.25 ml aliquots of cell suspension were combined with 0.25 ml of YPGal and cultured in 96-well plates (2 ml square wells) at 42° C. All selective cultures were incubated for 3 days with constant shaking at 800 rpm; those measuring heat tolerance at 42° C. and all others at 30° C.

The cultures for Table 7A (FIG. 5) were then spotted undiluted or in 1:10 dilutions (diluted in SCD-Ura) onto fresh 15 cm plates containing solid rich medium with glucose as a carbon source (YPD agar; for 1 L medium, 20 g Bacto Peptone, 10 g Bacto Yeast Extract and 15 g Bacto Agar are combined, and after autoclaving 20 g glucose are added as a 20% sterile solution). The spotting was done using a Bel-Art 96-well replicating tool (Bel-Art Products) that deposits spots of approximately 3 µl from each well onto the recipient plate. The spots were allowed to dry, the plates incubated at 30° C. for 1 day to allow surviving cells to grow into cell spots or individual colonies, and the cell density of each transformant for each selective condition scored on a relative scale from 0-3; 0 being no growth, 1 slight growth, 2 significant growth and 3 confluent growth. Both the undiluted and diluted spots were taken into account to generate the score. To obtain a final activity score for each fusion polynucleotide GAL1 centromeric plasmid and each selective condition, the triplicate scores for each selective condition were added, and the added triplicate score obtained with the control plasmid subtracted, and the result divided by the number of replicates (3). Final activity scores below zero were scored as zero. All scores are shown in Table 7A (FIG. 5) under the columns labeled 'Activity scores'.

Resistance and tolerance phenotypes of the 20 yeast strains shown in Table 7B (FIG. 6) to heat (42° C.), ethanol (15%), butanol (3%), low pH (pH 3.0 in 0.2M sodium acetate) and salt (2M NaCl) were measured in quadruplicate with four independent transformants of yeast strain BY4741 with each GAL1 centromeric plasmid. The strains were first grown in 96-well plates (2 ml square wells) containing minimal uracil dropout medium containing 2% raffinose as a carbon source (SCRaf-Ura; for 1 L medium, 6.7 g yeast nitrogen base and 0.77 g uracil dropout mix are combined, pH is adjusted to 5.6-5.8 with 120 µl 10N NaOH, and after autoclaving 20 g of raffinose are added as a sterile 20% solution). Cells were incubated for 16 hours at 30° C. with constant shaking at 800 rpm on a microshaker with a 3 mm radius of gyration.

The cell densities were then measured with a hemocytometer, and the cell suspensions diluted to a final cell density of $1 \times 10^7$ cells/ml in 1.25 rich medium containing raffinose and galactose as carbon sources (YPRaf-Gal; for 1 L medium, 20 g Bacto Peptone and 10 g Bacto Yeast Extract are combined and after autoclaving 20 g of raffinose and 20 g of galactose are added as sterile 20% solutions). The cell suspensions to fresh 96-well plates (2 ml square wells) and cultured for an additional 2 hours in the same manner. The cultures were then were then added in 0.25 ml aliquots to fresh 96-well plates (2 ml square wells) containing 0.25 ml per well of YPRaf-Gal with 2x concentration of one selective agent. The selective agents used were 15% final concentration of ethanol, 3% final concentration of n-butanol, 0.2M final concentration of sodium acetate pH 3.0 or 2M final concentration of NaCl, The sodium acetate was prepared as a 1M solution of sodium acetate pH 3.0 by mixing 2.74 ml glacial acetic acid with 0.11 g anhydrous sodium acetate in 50 ml final volume and filter sterilized using a 0.2 micron filter For measuring heat tolerance, the 0.25 ml aliquots of cell suspension were combined with 0.25 ml of YPRaf-Gal and cultured in 96-well plates (2 ml square wells) at 42° C. All selective cultures were incubated for 48 hours with constant shaking at 800 rpm; those measuring heat tolerance at 42° C. and all others at 30° C.

The cultures for Table 7B (FIG. 6) were then spotted undiluted or in 1:10 dilutions (diluted in SCD-Ura) onto fresh 15 cm plates containing solid rich medium with glucose as a carbon source (YPD agar; for 1 L medium, 20 g Bacto Peptone, 10 g Bacto Yeast Extract and 15 g Bacto Agar are combined, and after autoclaving 20 g glucose are added as a sterile 20% solution). The cultures were spotted using a Bel-Art Products Bel-Art 96-well replicating tool that deposits spots of approximately 3 µl from each well onto the recipient plate. The spots were allowed to dry, the plates incubated at 30° C. for 1 day to allow surviving cells to grow into cell spots or individual colonies, and the cell density of each transformant for each selective condition scored on a relative scale from 0-3; 0 being no growth, 1 slight growth, 2 significant growth and 3 confluent growth. Both the undiluted and diluted spots were taken into account to generate the score. To obtain a final activity score for each fusion polynucleotide GAL1 centromeric plasmid for each selective condition, the quadruplicate scores for each selective condition were added, and the added score obtained with the control plasmid subtracted, and the result divided by the number of replicates (4). Final activity scores below zero were scored as zero. All scores are shown in Table 7B (FIG. 6) under the columns labeled 'Activity scores'.

Yeast strain BY4741 transformed with the fusion polynucleotide GAL1 centromeric plasmids showed enhanced resistance to or tolerance of heat, ethanol, butanol, low pH and/or salt, compared to the individual ORF GAL1 centromeric plasmids, as shown in Table 7 (FIGS. 5 and 6). Yeast strain BY4741 containing the negative control plasmid p416-GAL1 (Mumberg 1995, Funk 2002) served as a control.

From the stress tolerance activities of the individual ORFs composing each fusion polynucleotide, the maximal expected stress tolerance score for each fusion polynucleotide can easily be calculated by adding the individual stress tolerance scores of each ORF contained in the fusion polynucleotide. Activities of the fusion polynucleotides that surpass this additive score are identified by grey shaded cells in Table 7 (FIGS. 5 and 6). The activity of the fusion polynucleotide would be expected to be equivalent to the individual value of one of the component ORFs and perhaps, in exceptional cases, to approach the additive score of the two component ORFs. However, the table shows that many of the fusion polynucleotide activities are even higher than the additive values. Fusion polynucleotide activity surpassed the additive activity levels in 19 out of 30 cases in Table 7A (FIG. 5) and 24 out of 45 cases in Table 7B (FIG. 6).

In one or more of the phenotypic categories (heat, ethanol, butanol, low pH and salt tolerance), each fusion polynucleotide listed in Table 7 (FIGS. 5 and 6) shows unexpected gain-of-function activity that is created by fusing together the two component ORFs. However, the expectation would have been that the activity of each fusion polynucleotide approximates the activity of one of the starting ORFs, or at best matches the additive activities of the two ORFs.

Activity scores of 14 fusion polynucleotide GAL1 centromeric plasmids and their 14 individual component ORFs are shown in Table 7 (FIGS. 5 and 6).

Example 8: Resistance and Tolerance Phenotypes in Glucose-Containing Media of Yeast Strains Transformed with Fusion Polynucleotide Centromeric Plasmids All 83 fusion polynucleotides (SEQ ID NOs 1-63 and 205-224) are cloned into the yeast expression vector p466-TEF1 (SEQ. ID No 128) which is similar to the yeast centromeric plasmid p416-TEF1 (Mumberg 1995, Funk 2002). The yeast centromeric plasmid p466-TEF1 contains the following sequences for plasmid propagation in yeast and E. coli, and expression of an inserted polynucleotide: the bacterial replicon of plasmid pMB1; the bacterial ampicillin-resistance gene; the yeast CEN6/ARSH4 cassette (Sikorski 1989) containing the chromosome 6 centromere and the yeast histone H4-associated autonomously replicating sequence (ARS); the yeast URA3 prototrophic marker gene; and the yeast TEF1 promoter placed adjacent to the CYC1 terminator in a manner that allows expression of coding regions inserted between them. The sequence of this p466-TEF1 expression vector is given in SEQ ID NO 128. All polynucleotides are cloned between nucleotide numbers 3029 and 3030 of SEQ ID NO 128.

The resulting set of constructs, referred to as 'fusion polynucleotide TEF1 centromeric plasmids', contain expression cassettes of the 83 fusion polynucleotides that are given in SEQ ID NOs: 1-63, and 205-224 under control of the S. cerevisiae TEF1 promoter. These constructs are used for quantitative determinations of yeast tolerance to the following stresses and toxic agents: alcohols (propanol, isopropanol, iso-butanol, pentanol, hexanol, heptanol, octanol, nonanol, decanol, undecanol and dodecanol), alkanes (butane, pentane, hexane, heptane, octane, nonane, decane, undecane, dodecane, hexadecane), heavy metal ions (various ions of the elements Ag, silver; As, arsenic; Cd, cadmium; Cr, chromium; Co, cobalt; Cu, copper; Hg, mercury; Ni, nickel; Pb, lead; Pt, platinum; Sb, antimony; Se, selenium; Tl, thallium; or Zn, zinc), oxidizing agents (hydrogen peroxide and other inorganic peroxides; inorganic oxidizing agents such as potassium permanganate; organic peroxides and hydroperoxides such as ethyl hydroperoxide, diacetyl peroxide, diethyl maleate, tert-butyl hydroperoxide, cumyl hydroperoxide and ascaridole; and other toxic compounds such as furfural, 5-hydroxymethylfurfural, benzoic acid derivatives (for example p-hydroxybenzoic acid), and other toxic lignin breakdown products found in sugar preparations derived from biomass (Luo 2002).

All experiments measuring tolerance and resistance activities of the fusion polynucleotides are performed using strain BY4741 (Brachmann 1998) transformed with each fusion polynucleotide TEF1 centromeric plasmid. Yeast transformations are performed using the lithium acetate-heat shock method as described in Example 2. The individual fusion polynucleotide TEF1 centromeric plasmid transformants of strain BY4741 are maintained on minimal uracil dropout solid medium containing glucose as a carbon source (SCD-Ura agar; for 1 L medium, 6.7 g yeast nitrogen base, 0.77 g uracil dropout mix, and 15 g Bacto Agar are combined, the pH is adjusted to 5.6-5.8 with 120 µl 10N NaOH and after autoclaving 20 g of glucose are added as a sterile 20% solution).

The tolerance determinations are performed either in rich medium containing glucose as a carbon source or in minimal medium containing glucose as a carbon source. The tolerance activities of each fusion polynucleotide TEF1 centromeric plasmid are measured in quadruplicate, with each of two independent transformants of each fusion polynucleotide TEF1 centromeric plasmid tested in duplicate.

Selective concentrations for all selective agents are determined by diluting an overnight culture of yeast strain BY4741 (Brachmann 1998) to a density of $5\times10^6$ cells/ml in rich medium containing glucose as a carbon source (YPD; for 1 L medium, 20 g Bacto Peptone and 10 g Bacto Yeast Extract are combined and after autoclaving 20 g glucose are added as a 20% sterile solution) or minimal medium containing glucose as a carbon source (SCD-Ura; for 1 L medium, 6.7 g yeast nitrogen base, 0.77 g uracil dropout mix and 25 ml of 2 mg/ml uracil are combined, the pH is adjusted to 5.6-5.8 with 120 µl 10N NaOH and after autoclaving 20 g of glucose are added as a sterile 20% solution). The cells are pre-cultured by adding 0.25 ml of the cell suspension to each well of a 96-well plate (2 ml square wells) and incubating for 2 hours at 30° C. with constant shaking at 800 rpm with a 3 mm radius of gyration. To each well, 0.25 ml of the same fresh medium is then added containing different concentrations of the selective agents. Selective concentrations for alcohols range between 0.025% and 25% depending on alcohol chain length (Fujita 2004). Selective concentrations for alkanes range between 1% and 25% depending on alkane chain length (Gill 1972, Fujita 2004); selective concentrations for heavy metal ions range between 0.5 µM and 10 mM (Bitton 1984, Hsu 1992, Nguyen-nhu 2002, Soares 2003); selective concentrations for oxidizing agents range from 2-100 mM for hydrogen peroxide, other inorganic peroxides and potassium permanganate, and 0.5-10 mM for organic peroxides and hydroperoxides (Krems 1995, Nguyen-nhu 2002, Miyazaki 2005); selective concentrations for furfural, hydroxymethylfurfural and p-hydroxybenzoic acid range from 2-100 mM (Palmqvist 1999, Liu 2005, Liu 2006, Heer 2008, Liu 2008, Tofighi 2010). The selective plates are sealed and incubated at 30° C. shaking at 800 rpm with a 3 mm radius of gyration for 48-96 hours. The cell density of each culture is then measured with a hemocytometer, and the growth inhibitory concentration of each compound determined. Cells from each growth inhibited culture are then plated on fresh YPD solid medium (YPD agar; for 1 L medium, 20 g Bacto Peptone, 10 g Bacto Yeast Extract and 15 g Bacto Agar are combined and after autoclaving 20 g glucose are added as a 20% sterile solution) and allowed to grow for 1-2 days to assess the relative number of viable cells in each culture and to determine the lethal concentration of each compound. The compounds are then divided into lethal and growth-inhibitory, with separate tolerance and resistance assays conducted for each class.

For measurement of the resistance to and tolerance of lethal compounds among the alcohols, alkanes, heavy metal ions, oxidizing agents and other toxic compounds listed above, the 84 yeast strains (BY4741 transformed with 83 fusion polynucleotide TEF1 centromeric plasmids plus one control vector) are first cultured in 96-well plates (2 ml square wells) in 1 ml per well of SCD-Ura. Cells are incubated for 16 hours at 30° C. with constant shaking at 800 rpm with a 3 mm radius of gyration. The cell densities are then measured with a hemocytometer and the cells diluted in a fresh 96-well plate (2 ml square wells) to a final cell density of $1\times10^7$ cells/ml in 1.25 ml SCD-Ura or YPD medium, and grown for an additional 2 hours. The cell suspensions are then added in 0.25 ml aliquots to fresh 96-well plates (2 ml square wells) and combined with 0.25 ml per well of fresh YPD medium or SCD-Ura medium, the freshly added medium containing 2× concentration of one selective agent. The selective agents used are listed above, and lethal concentrations of each are used in the selection. All selective cultures are cultured for 48-96 hours at 30° C. After the selection has been completed, the cultures are then diluted 1:10, 1:100 and 1:1000 in SCD-Ura liquid medium and 150 µl aliquots of the diluted cells are plated as ~1 in spots onto 15 cm plates containing SCD-Ura agar medium or YPD agar medium. The plates are allowed to dry and are incubated at 30° C. for 2 days to allow surviving cells to grow into colonies. The colonies are counted, the multiple counts for each fusion polynucleotide TEF1 centromeric plasmid are averaged and standard deviations are calculated, to determine the relative stress tolerance and resistance phenotypes conferred by each fusion polynucleotide.

For measurement of the resistance to and tolerance of growth-inhibitory compounds among the alcohols, alkanes, heavy metal ions, oxidizing agents and other toxic compounds listed above, the 84 yeast strains (BY4741 transformed with 83 fusion polynucleotide TEF1 centromeric plasmid plus one control vector) are first cultured in 96-well plates (2 ml square wells) in 1 ml per well of SCD-Ura. Cells are incubated for 16 hours at 30° C. with constant shaking at 800 rpm with a 3 mm radius of gyration. The cell density is then measured with a hemocytometer, and the cells diluted in a fresh 96-well plate (2 ml square wells) to a final cell density of $1\times10^7$ cells/ml in 1.25 ml SCD-Ura or YPD medium, and grown for an additional 2 hours. The cell suspensions are then added in 0.25 ml aliquots to fresh 96-well plates (2 ml square wells) and combined with 0.25 ml per well of fresh SCD-Ura or YPD medium, the freshly added medium containing 2× concentration of one selective agent. The selective agents used are listed above, and growth-inhibitory concentrations of each are used in the selection. All selective cultures are cultured for 48-96 hours at 30° C. After the selection has been completed, the cultures are diluted 1:100, 1:1000 and 1:10,000 in SCD-Ura liquid medium and 150 µl aliquots of the diluted cells are plated as ~1 in spots onto 15 cm plates containing SCD-Ura agar medium or YPD agar medium. The plates are allowed to dry and are incubated at 30° C. for 2 days to allow surviving cells to grow into colonies. The colonies are counted, the multiple counts for each fusion polynucleotide TEF1 centromeric plasmid are averaged and used to calculate the number of viable cells in each culture as well as standard deviations, to determine the relative stress tolerance and resistance phenotypes conferred by each fusion polynucleotide.

Example 9: Efficient Method for Selection of Heat-Tolerant Yeast Clones

A collection or library of *Saccharomyces cerevisiae* in-frame fusion polynucleotides is prepared as described in U.S. patent application Ser. No. 14/134,619 and International Patent Application Serial Number PCT/US13/76526. The randomized in-frame fusion polynucleotides are cloned into a vector molecule, such the yeast expression vector p416-GAL1 (Funk 2002). The sequence of a p416-GAL1 derivative vector is given in SEQ ID NO 127 and contains the following sequences for plasmid propagation in yeast and *E. coli* and expression of an inserted polynucleotide: the bacterial replicon of plasmid pMB1, the bacterial ampicillin/carbenicillin-resistance gene, the yeast CEN6/ARSH4 cassette (Sikorski 1989) containing the chromosome 6 centromere and the yeast histone H4-associated autonomously replicating sequence (ARS), the yeast URA3 prototrophic marker gene, and the yeast GAL1 promoter and CYC1 terminator placed adjacent to each other in a manner that allows insertion of coding regions in between to allow their expression. All randomized in-frame fusion polynucleotides are cloned between nucleotide numbers 3206 and 3207 of SEQ ID NO 127.

Yeast transformations are performed by the lithium acetate-heat shock method (Gietz 2002, Gietz 2006, Gietz 2007). The yeast strain BY4741 (Brachmann 1998) from a plate or an overnight culture is inoculated into 50 ml of YPD medium (for 1 L medium, 20 g Bacto Peptone, 10 g Bacto Yeast Extract are combined and after autoclaving 20 g Glucose are added as a 20% sterile solution) at 30° C. on a shaker at 225 rpm from a starting density of $5 \times 10^6$ cells/ml (cell density determined with a hemocytometer), and grown over several hours to a final cell density of $2 \times 10^7$ cells/ml. The cells are harvested by centrifuging at 3000 g for 5 min, are then resuspended in 25 ml of sterile deionized water, and centrifuged again. Cells are resuspended in 1 ml of sterile water, transferred to a 1.5 ml microcentrifuge tube, centrifuged for 30 sec at 3000 rpm and the supernatant aspirated. The cell pellet is then resuspended in 0.4 ml of sterile deionized water. The cell suspension is combined with 3.26 ml of transformation mix (2.4 ml of 50% w/v PEG 3350, 360 μl 1M Lithium acetate and 500 μl 10 mg/ml sheared, boiled salmon sperm DNA) and mixed well. Aliquots of DNA (100 ng-1 μg) are pipetted into separate 1.5 ml microcentrifuge tubes and combined with 380 μl of the cell suspension in transformation mix. The cell/DNA mixture is mixed thoroughly and is incubated at 42° C. on a shaker at 250 rpm for 40 minutes. The transformations are then centrifuged for 1 minute at 3000 rpm in a microcentrifuge, the supernatant aspirated and each cell aliquot resuspended in 0.5-1 ml sterile deionized water. Depending on the desired density of colonies, 10 μl to 1 ml of the cell suspension are plated with sterile 4 mm glass beads onto one 10 cm or 15 cm plate containing synthetic complete uracil dropout solid medium having glucose as a carbon source (SCD-Ura agar; for 1 L, 6.7 g yeast nitrogen base, 0.77 g uracil dropout mix and 15 g Bacto agar are combined, the pH is adjusted with 120 μl 10N NaOH to bring the pH to 5.6-5.8, and after autoclaving 20 g glucose are added as a 20% sterile solution). After drying, the plates are covered and incubated at 30° C. for 3-4 days until colonies of transformants have formed.

After formation of colonies or lawns of cells transformed with randomized in-frame fusion polynucleotides, the transformed cells are removed from the selective plates by scraping with glass beads. This is done by adding to each 10 cm plate 5 ml synthetic complete uracil dropout medium with galactose as a carbon source (SCGal-Ura; for 1 L medium, 6.7 g yeast nitrogen base and 0.77 g uracil dropout mix are combined, the pH is adjusted with 120 μl 10N NaOH to bring the pH to 5.6-5.8 and, after autoclaving, 20 g galactose are added as a sterile 20% solution) together with 10×4 mm glass beads. Proportionally higher volumes of medium are added to larger plates. Using swirling and horizontal shaking motions to allow the glass beads to dislodge the yeast cells from the surface of the agar, the resuspended cells are collected with a pipet, using additional medium if desired to wash any remaining cells off the plate. Cells collected in this fashion are pelleted by centrifugation at 4000 rpm for 5 minutes. Cells are resuspended in SCGal-Ura at a cell density of $5 \times 10^6$ cells/ml and cultured at 30° C. shaking at 250 rpm for 4-12 hours. This pre-culturing step allows induction of the GAL1 promoter used to express the randomized in-frame fusion polynucleotides.

For heat tolerance selection, tolerant cells are selected in liquid culture. The cell density in the suspension of yeast transformants containing in-frame fusion polynucleotides is determined with a hemocytometer, and the cells are suspended in SCGal-Ura at a cell density of $5 \times 10^6$ cells/ml in 50 ml of medium in a 500 ml flask and cultured at 40-44° C. shaking at 250 rpm for 7 days. This selective culture is referred to as the 'heat liquid selection culture'. Following the selection, 0.5 ml aliquots of the cell suspension are either plated directly on 15 cm SCD-Ura agar plates to select for surviving cells, or the cell suspension after selection is centrifuged at 3000 rpm for 5 minutes, the cell pellet suspended in 0.25 ml minimal uracil dropout solid medium with glucose as a carbon source (SCD-Ura; for 1 L, 6.7 g yeast nitrogen base and 0.77 g uracil dropout mix are combined, the pH is adjusted with 120 μl 10N NaOH to bring the pH to 5.6-5.8, and after autoclaving 20 g glucose are added as a 20% sterile solution) and plated on a 15 cm SCD-Ura agar plate. The plates are allowed to dry and incubated at 30° C. for 3-4 days until colonies have formed.

To boost the number of survivors from heat selection, it is advantageous to incubate the heat liquid selection culture at temperatures ranging from 4° C. to 25° C. either with or without shaking for 1-24 hours after removal from the heat selection. For example, following a heat selection at 42° C., the heat liquid selection culture is removed from the shaker in which the selection took place and transferred to room temperature where it is allowed to remain without shaking for 2 hours. The heat liquid selection culture is then incubated at 4° C. for 16 hours. The cells are then collected centrifuged at 3000 rpm for 5 minutes, the cell pellet suspended in 0.25 ml SCD-Ura and plated on a 15 cm SCD-Ura agar plate. The plate is allowed to dry and incubated at 30° C. for 3-4 days until colonies have formed. Comparison between the number of colonies formed when plating directly after heat selection, vs plating after successive incubation of the heat liquid selection culture at room temperature and 4° C. shows a greater number of colonies after successive incubation at room temperature and 4° C. by a factor of 2-50 over the control.

REFERENCES

Ashby M K, Houmard J (2006). Cyanobacterial two-component proteins: structure, diversity, distribution, and evolution. Microbiol Mol Biol Rev. 70(2):472-509.

Babushok D V, Ostertag E M, Kazazian H H Jr (2007). Current topics in genome evolution: molecular mechanisms of new gene formation. Cell Mol Life Sci. 64(5): 542-54.

Bianchi A, Shore D (2006). The KEOPS complex: a rosetta stone for telomere regulation? Cell 124(6):1125-1128.

Brachmann C B, Davies A, Cost G J, Caputo E, Li J, Hieter P, Boeke J D (1998). Designer deletion strains derived from *Saccharomyces cerevisiae* S288C: a useful set of strains and plasmids for PCR-mediated gene disruption and other applications. Yeast 14(2):115-132.

Cakar Z P, Turanli-Yildiz B, Alkim C, Yilmaz U (2012). Evolutionary engineering of *Saccharomyces cerevisiae* for improved industrially important properties. FEMS Yeast Res. 12(2):171-182.

Dismukes G C, Carried D, Bennette N, Ananyev G M, Posewitz M C (2008). Aquatic phototrophs: efficient alternatives to land-based crops for biofuels. Curr Opin Biotechnol. 19(3):235-240.

Doğan A. Demirel S, Aytekin A O. Sahin F (2014). Improvements of tolerance to stress conditions by genetic engineering in *Saccharomyces cerevisiae* during ethanol production. Appl Biochem Biotechnol. 174(1):28-42.

Dubouloz F, Deloche O, Wanke V, Cameroni E, De Virgilio C (2005). The TOR and EGO protein complexes orchestrate microautophagy in yeast. Mol Cell. 19(1):15-26.

Downey M, Houlsworth R, Maringele L, Rollie A, Brehme M, Galicia S, Guillard S, Partington M, Zubko M K, Krogan N J, Emili A, Greenblatt J F, Harrington L, Lydall D, Durocher D (2006). A genome-wide screen identifies the evolutionarily conserved KEOPS complex as a telomere regulator. Cell 124(6):1155-1168.

Eisenbeis S, Höcker B (2010). Evolutionary mechanism as a template for protein engineering. J Pept Sci. 16(10): 538-544.

Funk M, Niedenthal R, Mumberg D, Brinkmann K, Ronicke V, Henkel T (2002). Vector systems for heterologous expression of proteins in Saccharomyces cerevisiae. Methods Enzymol. 350:248-57.

Gao M, Kaiser C A (2006). A conserved GTPase-containing complex is required for intracellular sorting of the general amino-acid permease in yeast. Nat Cell Biol. 2006 8(7): 657-667.

Gietz R D, Woods R A (2001). Genetic transformation of yeast. Biotechniques 30(4):816-826.

Gietz R D, Woods R A (2002). Transformation of yeast by lithium acetate/single-stranded carrier DNA/polyethylene glycol method. Methods Enzymol. 350:87-96.

Gietz R D, Woods R A (2006). Yeast transformation by the LiAc/S S Carrier DNA/PEG method. Methods Mol Biol. 313:107-120.

Gietz R D, Schiestl R H (2007). High-efficiency yeast transformation using the LiAc/S S carrier DNA/PEG method. Nat Protocols 2(1):31-34.

Gilbert W (1978). Why genes in pieces? Nature 271(5645): 501.

Inaki K, Liu E T (2012). Structural mutations in cancer: mechanistic and functional insights. Trends Genet. 28(11):550-559.

Kaida D, Yashiroda H, Toh-e A, Kikuchi Y (2002). Yeast Whi2 and Psr1-phosphatase form a complex and regulate STRE-mediated gene expression. Genes Cells 7(6):543-552.

Kawai S, Hashimoto W, Murata K (2010). Transformation of Saccharomyces cerevisiae and other fungi: methods and possible underlying mechanism. Bioeng Bugs. 2010 November-December; 1(6):395-403.

Klinke H B, Thomsen A B, Ahring B K (2004) Inhibition of ethanol producing yeast and bacteria by degradation products produced during pre-treatment of biomass. Appl Microbiol Biotechnol. 66(1):10-16.

Leadsham J E, Miller K, Ayscough K R, Colombo S, Martegani E, Sudbery P, Gourlay C W (2009). Whi2p links nutritional sensing to actin-dependent Ras-cAMP-PKA regulation and apoptosis in yeast. J Cell Sci. 122(Pt 5):706-715.

Liu Z L, Slininger P J, Dien B S, Berhow M A, Kurtzman C P, Gorsich S W (2004). Adaptive response of yeasts to furfural and 5-hydroxymethylfurfural and new chemical evidence for HMF conversion to 2,5-bis-hydroxymethyl-furan. J Ind Microbiol Biotechnol. 31(8):345-352.

Luo C, Brink D, Blanch H (2002) Identification of potential fermentation inhibitors in conversion of hybrid poplar hydrolyzate to ethanol. Biomass Bioenergy 22(2):125-138

Marschalek R (2011). Mechanisms of leukemogenesis by MLL fusion proteins. Br J Haematol. 152(2):141-154.

Martin C, Jönsson, L J (2003). Comparison of the resistance of industrial and laboratory strains of Saccharomyces and Zygosaccharomyces to lignocellulose-derived fermentation inhibitors. Enzyme Microbial Technol. 32(3-4):386-395.

Melo J V (1996). The diversity of BCR-ABL fusion proteins and their relationship to leukemia phenotype. Blood 88(7):2375-2384.

Mendl N, Occhipinti A, Müller M, Wild P, Dikic I, Reichert A S (2011). Mitophagy in yeast is independent of mitochondrial fission and requires the stress response gene WHI2. J Cell Sci. 124(8):1339-1350.

Mitelman F, Johansson B, Mertens F (2004). Fusion genes and rearranged genes as a linear function of chromosome aberrations in cancer. Nat Genet. 36(4):331-334.

Mitelman F, Johansson B, Mertens F (2007). The impact of translocations and gene fusions on cancer causation. Nat Rev Cancer 7(4):233-245.

Modig T, Lidén G, Taherzadeh M J (2002). Inhibition effects of furfural on alcohol dehydrogenase, aldehyde dehydrogenase and pyruvate dehydrogenase. Biochem J. 363(3): 769-776.

Mountain H A, Sudbery P E. (1990). Regulation of the Saccharomyces cerevisiae WHI2 gene. J Gen Microbiol. 136(4):727-732.

Mountain H A, Sudbery P E. (1990a). The relationship of growth rate and catabolite repression with WHI2 expression and cell size in Saccharomyces cerevisiae. J Gen Microbiol. 136(4):733-737.

Müller M, Reichert A S. (2011). Mitophagy, mitochondrial dynamics and the general stress response in yeast. Biochem Soc Trans. 39(5):1514-1519.

Mumberg D, Müller R, Funk M (1995). Yeast vectors for the controlled expression of heterologous proteins in different genetic backgrounds. Gene 156(1):119-122.

Nieves L M, Panyon L A, Wang X (2015). Engineering Sugar Utilization and Microbial Tolerance toward Lignocellulose Conversion. Front Bioeng Biotechnol. 3:17.

Piper R C (2006). Successful transporter gets an EGO boost. Dev Cell. 11(1):6-7.

Rabbitts T H (2009). Commonality but diversity in cancer gene fusions. Cell 137(3):391-395.

Radcliffe P A, Binley K M, Trevethick J, Hall M, Sudbery P E (1997). Filamentous growth of the budding yeast Saccharomyces cerevisiae induced by overexpression of the WHi2 gene. Microbiology 143(6):1867-1876.

Saha B C (2003). Hemicellulose bioconversion. J Ind Microbiol Biotechnol. 2003 30(5):279-291.

Sambrook, J., Fritsch, E. F., and Maniatis, T. (1989) Molecular Cloning: A Laboratory Manual, Second Ed., Cold Spring Harbor Laboratory Press, Plainview, N.Y.

Saul D J, Sudbery P E (1985). Molecular cloning of WHI2, a gene involved in the regulation of cell proliferation in Saccharomyces cerevisiae. J Gen Microbiol. 131(7): 1797-1806.

Sawyers C L (1992). The bcr-abl gene in chronic myelogenous leukaemia. Cancer Surv. 15:37-51.

Sikorski R S, Hieter P (1989). A system of shuttle vectors and yeast host strains designed for efficient manipulation of DNA in Saccharomyces cerevisiae. Genetics 122(1): 19-27.

Whitworth D E, Cock P J (2009). Evolution of prokaryotic two-component systems: insights from comparative genomics. Amino Acids 37(3):459-66.

Zaldivar J, Nielsen J, Olsson L. Fuel ethanol production from lignocellulose: a challenge for metabolic engineering and process integration. Appl Microbiol Biotechnol. 56(1-2):17-34.

Zhang W, Fisher J F, Mobashery S. (2009). The bifunctional enzymes of antibiotic resistance. Curr Opin Microbiol. 12(5):505-511.

All publications, databases, GenBank sequences, patents and patent applications cited in this Specification are herein incorporated by reference as if each was specifically and individually indicated to be incorporated by reference.

SEQUENCE LISTING (244 sequences)

SEQ ID NO: 1 - DNA, 1719 bp, Saccharomyces cerevisiae
atgcgccgcctatatcgtcatcttgcttcctttttcttactcccttcctgccctggaaacaccatacaatccatcacatcatatcctgccaatgcactattacgcagctttcggcacgtgagtacggaaacaccagttcggaaccgggtacacaatagggatagtcaaagctgtccattttttccgctgatggatgacggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 2 - DNA, 1998 bp, Saccharomyces cerevisiae
atgaagtgcactttagtttccacattgtttgccatcaccaatattctagttgcacatgcacaagtaagcaactcctcagacacgttggacgtacaatttgcgaatagtacgaactcgtacatagaaggaaaatttaattcgactgatgaagccttcaacagcagcgcatcttggtccttagcagctcagcagaaaaagatatctaatgcagctgtatatgatgtgggtggttggaatggctcattgtatcgttccaatagaagcgctgttgcagatcatcaacccggcaaaaagcaagatgccgctatttcacagatcagtgatggtcaaatccaagccactgcgtctggacctgagactaccgctgctactaccccaagtagtaccgcaaatgtctctgtctatgaaggtgctggtatgaaggttgaatccaagaacatgggttatatagttggagtagcagcgctattatttttaggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 3 - DNA, 1947 bp, Saccharomyces cerevisiae
atgacagaggttgtgggattctgggagagcgtgtcagatgacgaatcagaagacaaagactgtatggaggtgcagaacacagtgagtgccgacgagagcccacttgtgcagagccttgtatcctttgtaggctcgtgctccatcaacctacttttgcccttcctcaacggcatgatgctcggcttcggcgagctatttgctcacgagctctgctggagattcaattggtttaaccatagaaacaaggggtataaggtgtacccagagtcgcgcaaaatagcagcattgaaagagatttcaagccctggcacccgtgggagggttgcgtccaagttccttggaagtgcagctcctggtgcatcagctgctccaggtgctggttctggaagtggttcaggaatgtttcaacgaaagactttacagagaaggaacttgaaagggctcaatcttaacctgcacccagatgtgggcaataatggccaattgcaggaaaagacagagactcaccagggacaatctcgaatagaaggccacgtgatgtctaacattaatgcaatacagaataatagcaacctgtttttgcgaagaggcataaaaaaaaaactgacgttggatgcgtttggtgatgaccaagctatatcgaaaccaaacactgtggtaatacagcaaccgcaaaatgaacctgttttagttctgtcttctctatcacaatccccgtgtgtatcatcatcatcatctttgtccacgccatgcattatagatgcgtacagtaataatttcggattatcgccatcatccacgaattctactccctctacgattcagggattgtccaatattgcaacaccagttgaaaacgaacattcgatatcactaccacctttggaggaaagcctatcgccagccgcagcagatctgaaagatacgttgtcgggaacttcaaatggtaattatatacaactccaggacttggttcagttggggaaaattggtgctggaaattctggaactgtggtgaaggcactacatgttcctgattccaaaatagttgccaaaaaaaccattcctgtggaacagaataacagtacaatcatcaaccaattagttagggaattatctatcgtcaaaaacgttaagccccatgaaaacattatcaccttctatggagcttattataaccagcatataaataatgaaatcataattttaatggaatactctgattgtggttctttagataaaatactgtccgtttataaaaggtttgttcaaagagggactgtttcgagtaagaaaacctggttcaacgaattaacaatatcaaaaatagcgtatggcgtactaaatggcttggatcatttgtaccgacaatataagatcattcatcgtgatatcaagccttccaatgttctgattaatagtaaggggcagattaagttatgtgattttggagtttccaaaaaactaataaattctatcgctgatacatttgttggaacgtccacttatatgtcaccagagaggatacaaggaaacgtttattctatcaaaggggacgtttggtcattgggcttaatgatcatcgagctggtaactggagagtttcccctaggtgggcataacgatacacctgatggcatattggatttgctgcaacgtattgtcaacgagccttcaccaagattacccaaagaccgtatctattccaaggaaatgacagattttgtcaataggtgttgtattaagaatgaaagggaaaggtcatcgattcatgaattgctacatcatgatcttataatgaaatacgtatcaccgtctaaagatgataaatttagacattggtgtagaaaaataaaatctaaaataaaggaagacaagagaattaaaagagaagccttggaccgtgccaagttagaaaagaaacaatcggaaagatcaacccattga

SEQ ID NO: 4 - DNA, 3120 bp, Saccharomyces cerevisiae
atggagcgattgaagcaactggaggaaaaaaggagacaattgaaagagctgcgtgagaggcgaaaacaagccagcttgttccctgggagcgagacgatgggccaccatcccacagaggtgcacgctaaggcaaccatggtcagcgtttcagtgcagaccgacatggaggaaggctcaaagattcaagagccccaatctgcatatcttcgacgtaaggaggttataacatacgacaaaggcattcaaacagatcaaattgaggaagaacaactgcaagaaaatgaaaatcacaccactactgatgctgtcgccattgaaactactgctgccgacgaaaataataaagacaaagctgaaaacgaccagccaaggttagaactagccaaaccttttcttgttgaagaggcggcggcaacgctgagcaacgctagttttgcgcggctggagacagaggtttctgcgtcaggccagcaggcgccatcgaacatgcaacaggataaagacaacctcatgcaatggaacatggtcagtgagaatttacaatcagagacagactgcgattgtatcgctcaggagtatgacccaggaaaaggcgtcttggttgtggtttatctacgattgccgccggcagacctacagtatgctagcagcgaagcggcgtggtctgtggtgaatgtagtcaagtgcgataatgccagcggacgcaacggcctcttgatagatatggtagagttccgtggtacgcggatcatgacagccacgatcctccgtcggtatcatccggaaagcaatgtaatatcaatcttgttggcgaccttgacgggcaagatcatattgtacgagcttagattgaaacagaaaaagccagaaacaccggtagtgtatgtcgtgcagcgaaatatggtggcaagacactactttcagcacccagtggtggctgtaattgaaacaagcagcgtgcaagatcaagagagagtacttgtggcagctgataatggcaatattatggagttgagctgcctggacttgactgttttgcggaagccacagcagctccgtcctgtaccgctatcacagcttttatctttggagaatgatacttgcacatatacggagcgattgcagcggttggcaaagtttgatgaggtaggtatagcttgcatggcgtacacgagtgaggacccgcagtacgtctggatcggtggcgaagacggtggtatatacaaggttttctgggaccaacctgggccgctgtacctctctttggacaacaatgggttccaacctgcagaaaaccactctacgagggtaaccgggttagagtttcattgggacgatgctcggcggctaatgcttctattatcatgttccacggactggacggtgcggctgtgggacgcgcgagcagggaaagctatcataggggcgccattgttgttaggggggcccgtactacgtgcacgctggctcgaaaaaaacaatggaggggaaaatagtcgcactctacggtgtcaagtgtggtgtgcagatggtcgcctcgttgttgtaaattgggctttcgatgctaagacgtccctctacacggccactgttatctccggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 5 - DNA, 2400 bp, Saccharomyces cerevisiae
atggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagggaagtgcagctcctggtgcatcagctgctccaggtgctggttctggaagtggttcaggaatggcatctgtgaacaattaccaggttgattgcgggtcaaggtctgctcgcattcaacccagaattaataacggcattcacgatgaagaatcgctatttgaagtcctggaactctcagaagaggaatttgagctagacttccatagattaaagtcattcaatgatgtaagggttatcaataacccagatttatctccagaatgtacaaatactgccattagtcgcgatgagacactggaatctgcaagtagtgccttcgaagttccttctgacgaaattgctatactgtcgatatccagtgacagcaataaaaattctccgccctcagagcagccggcgcccgctcttcgtaacattcgatcgtctagtaactctgaccggatcgatgagtggtgtttgggcagccatttatttaatgagctgcatcaaaatgtccctcaatcaagcgacggtgtcaatcatggatttcccgtttattcctttaaggaaagagaactttatacctctgcgaaattaaagaaacttacaaatgcccaaagaattgctgtgcagaaactatcaagagacttgtatccaattctaagaacatgctaccgcgagaaaactcgccggcaattattgacataccatcatgaaagaatatttgacgatataccatcttttttcccccagcgtgactttattttcaattactactcgatgcctcttgaattcgacaggttgtcagacgtagatatagattcgtcatcgcggtcacgatttacagatgagagcactggagaaacattaaaccgttcaccaagcgcagcgtcttcgtcgttggaaaacacatcttggtttggctggactttactttctaggtttttggacagagaatggtag

SEQ ID NO: 6 - DNA, 2142 bp, Saccharomyces cerevisiae
atgagtaatgcaaacaatagtgctatgaaccacatcacgttgcctcccatctcgtcatttgacaaccttatcaaggcagccgagagacaatataatggcgaggcttcgtccgcctcgacacatccgacactgcctaatatgaacattagtaacggcagtggcagtgcgggcgcatcatcgtcgatgctgagctatcagttgcttccgcactccaatgatgtgtcccggtcgaactccagctcgagcttccttccctccgtgcagcagcctacggaaggttccgcttctgcatcggaaacttcttcatctgcatcaccttcacgttccatttcaccaattttaaaagtggctggtccttcatctgttggcggtgccggggtgagtaccccccatagcaccaaaatcaataagccaaggaaaaagaagcaatgtccaatttgtcgtaatttttatgccaatctgaccacgcacaaggcaacgcacttgacgccagaggatcggcctcacaagtgtcccatctgccaccgcgggttcgccaggaacaatgacttattgaggcataagaaaagacattggaaggatgagatactgtcccaatcgggagtactttcgaaccataatgatggtaagggaggatccgtttctcccaatgatgatgatacccatgaaaaaatgacaccgatgaattctgtcacagattatgcacaattgaaatcgttgcatcaaatcaagggcacattcaagtgcccattcaactccaccttaatacaattggacatggatatgtacccgtataaactgaaacctttaaattttgagacttccaattgtcaccagacgggggtgttctcacgttgcgacaccttcaaaaaccatttaaaggctttgcattttgaatacccgccaggcacgaagaaaaaggatagaaatgttgttcctggtagatgtaagcattgcggcctgaagttcgagaacgttgacgtttggctcaacgaacacgtaggtaaacaatgcggctataaataccatggaagtgcagctcctggtgcatcagctgctccaggtgctggttctggaagtggttcaggaatgaattggctgtttttggtctcgctggttttcttctgcggcgtgtcaacccatcctgccctggcaatgtccagcaacagactactaaagctggctaataaatctcccaagaaaattatacctctgaaggactcaagttttgaaaacatcttggcaccacctcacgaaaatgcctatatagttgctctgtttactgccacagcgcccgaaattggctgttctctgtgtctcgagctagaatccgaatacgacaccatagtggcctcctggtttgatgatcatccggatgcaaaatcgtccaattccgatacatctattttcttcacaaaggtcaatttggaggacccttctaagaccattcctaaagcgttccagtttttccaactaaacaatgttcctagattgttcatcttcaaaccaaactctccctctattctggaccacagcgtgatcagtatttccactgatactggctcagaaagaatgaagcaaatcatacaagccattaagcagttctcgcaagtaaacgacttctctttacacttacctatggactggactccaattattacctcgacaataattaccttcatcaccgtcttactcttcaaaaagcagtccaaactcatgttctccatcatatcttccaggatcatctgggcaaccttgtcaacttttttcatcatttgcatgatcagtgcctatatgttcaaccaaatcaggaatacccaattggcaggcgttggtcctaagggcgaggttatgtatttcttgcccaatgaattccaacaccaattcgccattgaaactcaagtcatggttcttatttacggaacattggccgcgttggttgtcgtattggtcaagggtatacaattcttgcggtctcatttgtatccagagaccaagaaagcgtacttcattgatgctattttggcctccttttgtgccttattcatttatgtcttctttgctgctttgacaaccgtgttcacgataaagagtcctgcttacccttttcctttactaaggttatcggcaccattcaaataa

SEQ ID NO: 7 - DNA, 2697 bp, Saccharomyces cerevisiae
atggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagggaagtgcagctcctggtgcatcagctgctccaggtgctggttctggaagtggttcaggaatggcagacacaccctctgtggcagtacaggccccaccgggctatggtaagacggagttatttcatctccccttgatagcactggcgtctaagggcgacgtgaaatatgtgtcgtttctgtttgtaccgtacacagtgttgcttgctaattgcatgatcaggttgggccgacgcggttgcttgaatgtggcccctgtaagaaactttattgaagaaggttacgatggcgttactgatttatacgtggggatctacgatgatcttgctagcactaatttcacagacaggatagctgcgtgggagaatattgttgagtgcacctttaggaccaacaacgtaaaattgggttacctcattgtagatgagtttcacaactttgaaacggaggtctaccggcagtcgcaatttgggggcataactaaccttgattttgacgcttttgagaaagcaatctttttgagcggcacagcccctgaggctgtagctgatgctgcgttgcagcgtattgggcttacgggactggccaagaagtcgatggacatcaacgagctcaaacggtcggaagatctcagcagaggtctatccagctatccaacacggatgtttaatctaatcaaggagaaatccgaggtgcctttagggcatgttcataaaatttggaagaaagtggaatcacagcccgaagaagcactgaagcttcttttagccctctttgaaattgaaccagagtcgaaggccattgtagttgcaagcacaaccaacgaagtggaagaattggcctgctcttggagaaagtattttagggtggtatggatacacgggaagctgggtgctgcagaaaaggtgtctcgcacaaaggagtttgtcactgacggtagcatgcaagttctcatcggaacgaaattagtgactgaaggaattgacattaagcaattgatgatggtgatcatgcttgataatagacttaatattattgagctcattcaaggtgtagggagactaagagatgggggcctctgttatctattatctagaaaaaacagttgggcggcaaggaatcgtaagggtgaattaccaccaattaaggaaggctgtataaccgaacaggtacgcgagttctatggacttgaatcaaagaaaggaaaaaagggccagcatgttggatgctgtgtctgctga

SEQ ID NO: 8 - DNA, 3336 bp, Saccharomyces cerevisiae
atgcagacgtcaatggtgagcgcaaaagttagtatatggctagtatgtagcgttatatgcagtagcctggtacgggctacgcaatctgtgtgttcgtcgcaaaacacagcgaccactgacggtgtacgaaatcaatttcagagtaatggttggtgttcaaataactgtgctggtcatcagtttgccatcgtacaggggttcatgtgctggtgcagtgattcggaaccgagcactcagacatcggtgggagactgcagtggcacttgtcccggttatggctacgaagattgtggtaatgcggataaggatctttttggttatatatatctggggcaaaccccgctaagttctgtacagagtgtggaaacgtcaacagagtccagtgtgtacgtttcaagtagctctatcacgagtagtagtagtacgagtattgtggacacaaccacaatctcgccgactctgacgtcaacgagtacgaccccattgacaaccgcctcaaccagtacaacaccatcaactgatataacatcggcactgcccacgactacaagcacaaagttgtcaacatccattcccacaagcacgacatcgtcaacctctaccaccacaagtacctcatcgtcgacttctacgaccgtaagtgtcacatcatcaacatctaccaccacaagtactacgtcgtcaaccctcatttccacgagcacatcatcatcatcatcatcaactccaaccacaacatcgtcagcccccatttctacaagcacgacgtcgtcaacttccacttcaacaagtacaacatcgccaacttcttcttcagcacctacaagctcgtctaatacaacaccaacgagcacaacgttcactacgacatcacccagtacagccccttcaagcactacggttacttacaccagtaccacagcatctccaataacgtccactataacttctgtaaacctgcagacctccttaaagtattctgtgataacagtgacttcagtgcacaccatggacactaacatttcggaaatcacctcgagatatctcaccatgaaaaaagtaataacgcagatttactcttccaccctcggggctactcctacttctgcagtggctactacgtctgccagcgtaggtggtagaataacaaacaataacaatagtaacaccaccaacagcaatacaccaactaacaagtctacagaaaagaaagggtactgggattcgcccgggaaaatagccgctactttcgtcgtggttggagtggtatgtttggtaattatatgcatactaatatacttaatacatcattatagaacaagacccgctcggaaggctcaagattttgagaatgaatatcagagtaagttttaccagtccaagtacccaaatgaagttaccactaccacgttacacacgccttcaccatcttcaaattcaactttctcgaccccaagattaatatacactgatgaaaagggacaaattatgtctgaatcaccatccccacgtcaatctacgtattccttgactgcaggcagtccaccaaatgacccaagcacgttggcaagcccatttcacgatcccattcttcccagaagaacttctacttttcttcattcgcccattcaaaagcaacacgaaaaaatggaatcaaacgttactctaggtgaagacacggtactggtggatcagaggctagacccaagtaagatgcttaacactttagcaaatgacgatgccacaaaccactctaccatttcgttatcagacaacgtagactactccaggagggttctgcggctaatgaacgaaggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 9 - DNA, 2358 bp, Saccharomyces cerevisiae
atgggcgacgaattacacaaccgtttacttcaccaaaacgatggcaccaaggacgccatactttataagataatagaatcgttagtttgctccatctgccacgattatatgtttgtaccgatgatgacaccttgtggtcataattattgctatggttgtctgaacacctggtttgccagcaatactcaaaaagaattggcttgtccgcagtgcagatctgatattaccaccattcccgcattgaatacaacgttgcaacagtatctatcattcattttagagaaattaagggaccagaatgatgaatcttttaaaaaacttttaacaactaaaaccaaggaggaaaatgattacaagaatgacaaggaaaaggacacattgtttgacaaagtatttaagaatagcgcattggcagtggccgacgactcggatgatggtatcacacgttgtagtaattgtcattgggaattagacccagacgaagtagaggacggaaatgtttgtccccactgcaatgccagaatacggaattacgcaggtggtcgcgacgaatttgatgaagaagaatacagtgaaggagagttggatgaaatccgggaaagcatgcgtaggcgtagagagaatcgatttgcgtctaccaatccgtttgctaatagagatgatgtaagttctgaagacgatgatagcagtgaagaggagcccatgcgagaacatatcccactaggccgttgggccaggtcacataatcgtagtattgctgtggatgctgtggatgatgaagacgacgaaggaagtgcagctcctggtgcatcagctgctccaggtgctggttctggaagtggttcaggaatgctgctggacgtgaacacaaatcacacactaatgcacgatgctcatgtgcatgaacattgcctcatcaaaagcatacgtgatgatggcgcattgcactcatggagcgactcatcaaaggtattttatcccaagtcattttacgctaccgctactaataagaagaataacaagttagccagcgccagcatgaacaagaccgccacaagtaataggacggtgagcgatgagatttatttccactccactaagccgcagttcgatggtcaaggaagcgctgaacgtactagaacactaaccaagaggaatagcttcaagaggactagaatactgaaggctcgagacgattccgaactgctgaacgaaaatcgctcatctttgatgaccccgtccttaagctcggtcatgtcgcaagttaggaaaacaaattccgccaagacgttatcgggcgaatgccccatacatgagggccacttaacacagagcataaagaggaagttctccgaggaagctcaaagcgactgttcttcattgagctcctctaaacttcatcccttgacagatgatattgctgacgctgtcgatttgcagacccccgcgattggcgatgaggtactggctgagccggtcgtgcccaaaatgaaaataataaacataaatgatctcgatttgttcgacgactgggaggttaaggatttagtcgatatctttcctcccgtatacgaacggcgtccgcgatcgtcctctgccctttcactggtttctgcgtcgtccgatgccaaacttcgtccgacctctgtggacttccaaatcatcgacaagaaaggcggcaagacttcaagaaggaagagtaggagcaaatcgactacagaaaacatgatttacgaaaatgacctggtagaattagaacaatggccatctgcatcaccatcgcccgagaccgacggttcgattgcatctagcgagctcttgcccaataaaagaataagacaaaaaagtttgaataccaatttcctaaagttatactctattgaaacatcatgtaaaaggaagagtattttacccgaagtcgaagtagatgaccatctgttgaagcagctaacgtattccgaaattcggtctttggaaatcaaaaaggagccaaatgtctctacgaacgatattaagcttgccctaattactaggaaaaaattatggtctgacatggtccatgaaacaagaaatgatctttttggcgattctaccccctggaatttgcactttgttgcaacgacaagcaatacggaaccttcgcaaggccgtgaatccgcaagcgaacatgcaacggcggatttgaaaagttctttggtccgcgtacactcagacgtcaagccatggttcaacaatggcggcacaatgctcaaaccatgcggaaaactaaatttaggcaaagtcaccaataagacttccgcacctacgagagagattcaatatgtcgtaaagggctggtgtgacagcaggtttctctga

SEQ ID NO: 10 - DNA, 2697 bp, Saccharomyces cerevisiae
atggcagacacaccctctgtggcagtacaggccccaccgggctatggtaagacggagttatttcatctccccttgatagcactggcgtctaagggcgacgtgaaatatgtgtcgtttctgtttgtaccgtacacagtgttgcttgctaattgcatgatcaggttgggccgacgcggttgcttgaatgtggcccctgtaagaaactttattgaagaaggttacgatggcgttactgatttatacgtggggatctacgatgatcttgctagcactaatttcacagacaggatagctgcgtgggagaatattgttgagtgcacctttaggaccaacaacgtaaaattgggttacctcattgtagatgagtttcacaactttgaaacggaggtctaccggcagtcgcaatttgggggcataactaaccttgattttgacgcttttgagaaagcaatctttttgagcggcacagcccctgaggctgtagctgatgctgcgttgcagcgtattgggcttacgggactggccaagaagtcgatggacatcaacgagctcaaacggtcggaagatctcagcagaggtctatccagctatccaacacggatgtttaatctaatcaaggagaaatccgaggtgcctttagggcatgttcataaaatttggaagaaagtggaatcacagcccgaagaagcactgaagcttcttttagccctctttgaaattgaaccagagtcgaaggccattgtagttgcaagcacaaccaacgaagtggaagaattggcctgctcttggagaaagtattttagggtggtatggatacacgggaagctgggtgctgcagaaaaggtgtctcgcacaaaggagtttgtcactgacggtagcatgcaagttctcatcggaacgaaattagtgactgaaggaattgacattaagcaattgatgatggtgatcatgcttgataatagacttaatattattgagctcattcaaggtgtagggagactaagagatgggggcctctgttatctattatctagaaaaaacagttgggcggcaaggaatcgtaagggtgaattaccaccaattaaggaaggctgtataaccgaacaggtacgcgagttctatggacttgaatcaaagaaaggaaaaaagggccagcatgttggatgctgtgtctgcggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 11 - DNA, 2448 bp, Saccharomyces cerevisiae
atgtctgccgttttcaacaacgctaccctttcaggtctagtccaagcaagcacctactcacaaactttgcaaaatgtcgcccattaccaacctcaattgaatttcatggagaaatactgggccgcatggtacagttacatgaacaatgatgttttggccaccggtctaatgttctttttattgcatgaatttatgtatttctttagatgtttgccatggttcatcatcgaccaaattccatactttagaagatggaagttacaaccaactaagattccaagtgctaaggaacaactatactgtttgaaatccgttcttctatctcatttcttggtcgaggccatccctatctggaccttccacccaatgtgtgaaaaattaggtattactgtcgaagttccattcccatctttgaaaacaatggctctagaaattggtctattcttcgtcttggaagatacatggcattactgggctcaccgtctattccactacggtgtcttctacaagtacattcacaagcaacatcacagatacgctgctccattcggtctttctgctgaatatgctcatcctgctgaaactttgtctttgggttttggtaccgttggtatgccaattctttacgtcatgtacactggtaaattacacttgttcactctatgtgtatggatcaccctaagattattccaagctgttgactctcattctggttatgacttcccatggtctttgaacaagatcatgccattctgggctggcgctgaacaccacgatttgcatcatcactactttattggtaactacgcttcctctttcagatggtgggattactgtctagacactgaatctggtccagaagctaaggcctccagagaagaaagaatgaagaagagagctgaaaacaatgctcaaaagaagactaacggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 12 - DNA, 2022 bp, Saccharomyces cerevisiae
atgaacaacgagactagtggtaaagaaacggcgtctgcacctctgtgttcgcccaagttacctgtagaaaaagtgcagagaatagccaagaatgatccagaatatatggacacttcggatgacgcattcgtagccacagcgtttgctacagaattcttcgtccaggtgctgacacatgagtccctacataggcaacagcagcagcaacaacaacaggtaccgccgctcccagatgaactcacgctgtcgtacgatgacatctctgccgcaattgtgcactcttctgacggccatctgcagtttttgaatgatgtgataccaacaacaaagaatttgaggcttctagtggaagaaaaccgagttagatatactacaagtgtcatgccccctaatgaagtttactccgcctatgtggtgaacgatacggctccgaagcccaacattgtcgagattgatcttgataatgacgaagacgacgacgaagacgttactgatcaagaaggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 13 - DNA, 2217 bp, Saccharomyces cerevisiae
atgctgctggacgtgaacacaaatcacacactaatgcacgatgctcatgtgcatgaacattgcctcatcaaaagcatacgtgatgatggcgcattgcactcatggagcgactcatcaaaggtattttatcccaagtcattttacgctaccgctactaataagaagaataacaagttagccagcgccagcatgaacaagaccgccacaagtaataggacggtgagcgatgagatttatttccactccactaagccgcagttcgatggtcaaggaagcgctgaacgtactagaacactaaccaagaggaatagcttcaagaggactagaatactgaaggctcgagacgattccgaactgctgaacgaaaatcgctcatctttgatgaccccgtccttaagctcggtcatgtcgcaagttaggaaaacaaattccgccaagacgttatcgggcgaatgccccatacatgagggccacttaacacagagcataaagaggaagttctccgaggaagctcaaagcgactgttcttcattgagctcctctaaacttcatcccttgacagatgatattgctgacgctgtcgatttgcagacccccgcgattggcgatgaggtactggctgagccggtcgtgcccaaaatgaaaataataaacataaatgatctcgatttgttcgacgactgggaggttaaggatttagtcgatatctttcctcccgtatacgaacggcgtccgcgatcgtcctctgccctttcactggtttctgcgtcgtccgatgccaaacttcgtccgacctctgtggacttccaaatcatcgacaagaaaggcggcaagacttcaagaaggaagagtaggagcaaatcgactacagaaaacatgatttacgaaaatgacctggtagaattagaacaatggccatctgcatcaccatcgcccgagaccgacggttcgattgcatctagcgagctcttgcccaataaaagaataagacaaaaaagtttgaataccaatttcctaaagttatactctattgaaacatcatgtaaaaggaagagtattttacccgaagtcgaagtagatgaccatctgttgaagcagctaacgtattccgaaattcggtctttggaaatcaaaaaggagccaaatgtctctacgaacgatattaagcttgccctaattactaggaaaaaattatggtctgacatggtccatgaaacaagaaatgatctttttggcgattctaccccctggaatttgcactttgttgcaacgacaagcaatacggaaccttcgcaaggccgtgaatccgcaagcgaacatgcaacggcggatttgaaaagttctttggtccgcgtacactcagacgtcaagccatggttcaacaatggcggcacaatgctcaaaccatgcggaaaactaaatttaggcaaagtcaccaataagacttccgcacctacgagagagattcaatatgtcgtaaagggctggtgtgacagcaggtttctcggaagtgcagctcctggtgcatcagctgctccaggtgctggttctggaagtggttcaggaatgtccgataaagttattaaccctcaagttgcatgggctcaaaggtctagtactactgatccagaaagaaattatgtcttaataactgtgtcaattgcagactgtgatgcccctgagttaaccattaagccatcatacatcgaattaaaggctcaatcaaagcctcatgttggcgatgaaaatgtccatcattatcaattacacattgatctatacaaggaaattatacctgaaaaaacaatgcataaggttgctaatggccagcactactttttgaaattgtataaaaaggatttagaatctgaatactggccacgtttgacaaaggaaaaggtgaagtacccttacatcaaaactgatttcgataaatgggttgatgaagatgaacaagacgaagttgaagctgaaggtaatgatgccgctcaaggaatggatttcagccaaatgatgggaggtgctggaggtgctggaggtgctggaggcatggacttcagccaaatgatgggaggtgctggtggcgctggttctccagatatggctcaattgcagcaattattggctcaaagcggtggtaatttggacatgggagatttcaaagaaaacgatgaagaagatgaagaagaggaaatagagccggaagtgaaagcttaa

SEQ ID NO: 14 - DNA, 2247 bp, Saccharomyces cerevisiae
atggctacaccaagcacgggagcaaacaattctatacctgcggtacgaaatcaggttgaagttcaggttggattagtaggggatgcacaagtagggaaaacatcgctgatggtgaagtacgtacagaacatatacgataaggaatacacacagacgctgggagtgaactttttgaaaagaaaagtaagcatacgctccacggatattatattttctataatggatttaggcggacaaagagaattcatcaacatgctcccaattgcgacggtagggtcttcagtgatcatatttctgtttgacctgacacgtccagagacgttgagttcaataaaggagtggtataggcaggcgtacgggctaaatgattcggcaattcctattttggtgggcacaaagtacgatttactaatagacttagacccggaatatcaggaacaaatctcgagaacgagtatgaagtatgcacaggtcatgaatgctcctcttatattctgctctactgccaaatctataaacattcaaaaaattttcaaaattgcactggcaaagatctttaatttgacattaaccatcccagaaatcaatgaaatcggcgatcctcttttgatatataagcacctaggtggccagcaacatcgacatcataacaaaagtcaggatagaaagagccataatatcaggaagccctcctcgtcgccctcatctaaggcaccatcgccgggcggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 15 - DNA, 2170 bp, Saccharomyces cerevisiae
atggtagtatccatcataccgcaatttcctgatatcaaggtttcactagcattgtttgaacaggttaaaaatgctaaagaaatacgctctaaaatgagtgaattgtcgacatcctttgcctttattgacccccggttagtctgttcgggggagcagatgtattctgcaatttacaagaccttaatagaagtgaaatataacaagatgagaacaagaaatttgaattccgagtgcgtactatgtctttcacccacttccaatattagtgatgctttcctcaaattcggaatcaaagacgattcgtcacagttaatatgccttaagttccatactaatactgacgatgtagacaaagagcaattgaggacgattatgacttctatagtaaaaggacaagagatcgagtttaatgatgacaatttatcgagattttatgacgaagcgctcataagaaaagtatgttttaataataaattcgaggtaaaaacttcaacagcctcaccagaaacacattgtactaacttcacctttgttttccttttattttgtttttacctattagatctataaattaagtgatgatttcaagccccaagacgtaaatggtctctcaagagctttggtagacgctattcaattgaggggtgtgggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 16 - DNA, 1635 bp, Saccharomyces cerevisiae
atgtccctacggccttgtctaacaccatccagcatgcaatacagtgacatatatatacccacacactctctcacatctacctctactctcgctgtcataccttacccggctttcggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 17 - DNA, 3462 bp, Saccharomyces cerevisiae
atggaagctggcaggagtgctgatgaagtgctataccacaatcagtcgtcagtaaagttaggtgagttagaaagatacgttattacatatgagctataccagggtgatagtattcccgctgatatcacactggattccctatgggtaaagatcaaaaataccacaaagctatcctataaaccagcctatctattgggcccatttatcttatattgtgacgtgcgagcaaaagattacgaaagctcgtataagatcatatgttcggcggataaaccagtatttcaatcaaacctacaggcacaacaaaagtttattgcagagttgtccttgcaccacattaagccacgctatgtatggatagtggatattgtcagtcaaatactatttaataaagaaactaaggtaacttttgagatagtagtcggcaattcaaaggcctctttgaaaagaaaaatacgatgtaatgattcattgcctgataaagcctgcaatattttacacacaggattatcggtgcatagacttaccaccgcagatatatggaaagtaccacgacccatagacatgtcgcaaaaatcccatttagtcattctcacgcatggttttcaatcaaacgtttcggcagatatggaatacttaatggaagaaatatacaaggctcaaatgaacaatccaaatgagcgactagttattaagggatatatgaagaatgcttgtgagactgagaagggtattaagtttttgggtgttggattggcaaactacatcatcgacgagttatatgatgactctgttgggaaaatttcatttattggtcattccctgggtggattaacacaaacttttgctatttgttacataaagaccaaatatccatatttctttaagaaagtggagccaatcaattttatctcactggcgtcaccattgctaggcattgctaccagcacgcccaattacgtaaaaatgtcattgtcgatgggtatcattggtactacggggcaagaactgggtcttaaggatggaaattatggtgataagcccctactttacctgctatccgaggaatccttaatcagtgtgcttgctcgattcaaaagaagaacactttatgctaatgccgtcaacgacggaatagttcccttgtactcctcttctttactttttttggactactctcaattacttcagaaactgggaggtcaaactacggcaccttgtgatcctctcttccagcctgaagtaagtcctattggggaacttccaaatcatagcgatgttgctaatgatgatgatggaatcaatgcatcgtcatggaacacgttttggaagagcaaggaaaataactgcgacaagaaatctaaacgcttgatgaatgcttccgtcatcaaatctatgaagtctgtgcttctatcaccatgccccgacgcaaagttcttctcagatcccgatgcaagggtcgcaacaatcatacatgataagatctacacagaaaagaatttaccgcctccatcaccaacactttatgaaggaacagcagccaaggaaggcgaaacgaggaagacgagaaaagagatggaggaaatcatagcacgccgctggcacaaggggatgcattggaggaaagtcgtggtattgctgaaaccagatgcccacaataacatcatcgtaagaagaaggttttccaacgcttacggctggccggtggttgaccaccttgttaccgcccatttccaaagagatgacccaatcgcctcaccaatgcaagataaacagtttgctgaggaagatataaacatggcaaccggaggggtggaaccaaacaagttctactcatggctcaccaagatcgaggatcctagtgtgtaccatggtggaatagtctccacagctagccagctcgccagctcctggattagcaagcattcctctgtgacagatggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 18 - DNA, 1668 bp, Saccharomyces cerevisiae
atgtggagacgtcggcgcgagccctgggaggagttatcttttcttcttaacagcttatcaccccggaattggtttatccggagatggggtcttatggctggaagaggccagcacctttgctggctccggtgcgcttgtgacggcccgggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 19 - DNA, 2316 bp, Saccharomyces cerevisiae
atgagtggcacgaggtgtttgctaggcgtcggactaccagttgatgtgactgctacggaaactttgactcatgatgaacaaggaccaggtgtagagccaggaccgtgttcgcgaggaagttctatagatggtctgctgccctcgttgctcggtccacatgatgatgtggatgacgattcggcggcttttcacaagtacatgacactatcgcgagatggcgcaggcgccatccatgctccgtcattagtcgaagacgcctcaaggaacgacgacgacgacgatgatgaagacgacgacgacagttccatgtcgcgagacctatccaaggctctagatatgtcatcgtcatcatcgtccagcccgcgcgttcaaagtcggcggcaccgtagttctgtgagcgcaatatctgcaatcttacaccaaggaaaatctggccgcgaagacataactggaagccttagcgttccggcagaacaagaaaaactcagttttcttgccaaagcctcgagtattttctttcgaaggaacagtatgcccagagacaaacatacgcattcagtatgtcccgctagccgcccagattccgagagatttatcgtcacatctgcagccgcgcagtctttacgccgccaacaacaactggaagacgctcagtacgctcgagttattacaaactttcgtactataggatggtgctctcccagcgagatagagtctgtggaatataaacggtccttgatcaatgcggagtgggacgaaaagatctcgcttttgtctcacgcgcaatgctataaaggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 20 - DNA, 2184 bp, Saccharomyces cerevisiae
atggccagcatagacgcattttcggaccttgagcgccggatggacgggttccaaaaggacgtggcccaggtactggcacgtcagcaaaaccacgcgcgccaacagctgcaacagttccaagcggaaatgcgtcaattacataaccaacaccaacatctcatagatgaactgcaacggcttgccacccagcgcaccgctctgcagcaacaaatacatgcggcccaacaagctacaaataccaccagagagcagtggagaagctatcacgagcgtgaatctgagttatctagacggcagtcgaccttagcagcccaatcgcgcgagctggactcgctgctgcaacagcgtggtaaagagtgtgtccaattacgcgcacgttgggctgcgcagtcgggtaacgatgccgcagaggtcgcactgtacgaacggctgttgcagcttcgtgtactacccggagccagcgatgtgcatgacgtacgtttcgtattcggcgatgattcacgctgctggatcgaagtcgcgatgcacggagaccacgtgatcggaaactctcacccggcgctggaccccaagagtcgggcaacacttgagcacgtgcttaccgtccagggcgacctcgcggcatttttagtcgtggcccgcgatatgcttctggcatctttaggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 21 - DNA, 3147 bp, Saccharomyces cerevisiae
atgggcaatcagtcattagttgtgcttacggaaagtaagggtgagtatgagaatgagacagaactacctgttaaaaaatcgtcacgagataataatatcggagaatctttaacagcaacagcttttacgcagtctgaagatgaaatggtagatagcaatcagaaatggcagaacccaaactattttaaatatgcatggcaagaatatctttttatattcacatgcatgataagtcagcttctaaatcaagcaggcactacacagactctttcgatcatgaatattctttcggacagttttggctcagaaggaaactcaaagtcatggctgatggcatcttttccgctagtttcaggctcatttattttgattagtggcagactaggtgacatatacggattaaaaaaaatgttgttagtaggatatgttctggttattatatggtctttgatttgtgggattaccaagtattctggtagcgatactttttttattattagtagagccttccaagggctagggattgcatttgttttacctaatgtgctgggaataattggtaatatatatgtaggtggtacttttcgtaaaaacatcgtgattagttttgttggtgcgatggcccctattggagcaactttaggttgtctttttgcaggactgatcggtaccgaggacccaaaacaatggccatgggcattctacgcgtatagcatagccgctttcattaattttgtgctctccatatatgccattccgagtactataccaacaaatattcatcatttttctatggattggattggttctgttttgggcgtgataggtctcattttattaaattttgtgtggaaccaagctcctatatcgggttggaaccaggcttacatcatcgtaattttaatcatttctgtgatttttcttgtcgttttcatcatttatgagattcgatttgccaagactccactattgccgcgcgcagttataaaggatcgtcatatgattcaaattatgctggctttattctttggatggggctcttttggcatctttacgttttattatttccaatttcaattaaatataaggcagtacacggcattatgggctggtggaacttactttatgtttttaatttggggtattattgccgccttactggtaggatttactatcaagaatgtgtctccatcagtgtttttgttcttttctatggtagcattcaatgtgggctcaataatggcaagtgttacaccggttcacgagacatactttcgtactcagttaggaacgatgataattttaagttttgggatggatctttcatttcctgcttcttccattatctttagtgataatttaccgatggagtaccaaggcatggctgggtcattggtgaatactgttgtcaattactccatgtccttgtgtctcggtatgggtgccacagtagagacacaggtcaattcagacggaaagcatcttttgaaaggctatagaggtgctcagtaccttgggataggattggcaagtttagcatgcatgattagcgggctttacatggtcgaaagcttcataaaaggccgcagggcaagagctgctgcagaatacgattgcactgtggctggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 22 - DNA, 3512 bp, Saccharomyces cerevisiae
atgctgctggacgtgaacacaaatcacacactaatgcacgatgctcatgtgcatgaacattgcctcatcaaaagcatacgtgatgatggcgcattgcactcatggagcgactcatcaaaggtattttatcccaagtcattttacgctaccgctactaataagaagaataacaagttagccagcgccagcatgaacaagaccgccacaagtaataggacggtgagcgatgagatttatttccactccactaagccgcagttcgatggtcaaggaagcgctgaacgtactagaacactaaccaagaggaatagcttcaagaggactagaatactgaaggctcgagacgattccgaactgctgaacgaaaatcgctcatctttgatgaccccgtccttaagctcggtcatgtcgcaagttaggaaaacaaattccgccaagacgttatcgggcgaatgccccatacatgagggccacttaacacagagcataaagaggaagttctccgaggaagctcaaagcgactgttcttcattgagctcctctaaacttcatcccttgacagatgatattgctgacgctgtcgatttgcagacccccgcgattggcgatgaggtactggctgagccggtcgtgcccaaaatgaaaataataaacataaatgatctcgatttgttcgacgactgggaggttaaggatttagtcgatatctttcctcccgtatacgaacggcgtccgcgatcgtcctctgccctttcactggtttctgcgtcgtccgatgccaaacttcgtccgacctctgtggacttccaaatcatcgacaagaaaggcggcaagacttcaagaaggaagagtaggagcaaatcgactacagaaaacatgatttacgaaaatgacctggtagaattagaacaatggccatctgcatcaccatcgcccgagaccgacggttcgattgcatctagcgagctcttgcccaataaaagaataagacaaaaaagtttgaataccaatttcctaaagttatactctattgaaacatcatgtaaaaggaagagtattttacccgaagtcgaagtagatgaccatctgttgaagcagctaacgtattccgaaattcggtctttggaaatcaaaaaggagccaaatgtctctacgaacgatattaagcttgccctaattactaggaaaaaattatggtctgacatggtccatgaaacaagaaatgatctttttggcgattctaccccctggaatttgcactttgttgcaacgacaagcaatacggaaccttcgcaaggccgtgaatccgcaagcgaacatgcaacggcggatttgaaaagttctttggtccgcgtacactcagacgtcaagccatggttcaacaatggcggcacaatgctcaaaccatgcggaaaactaaatttaggcaaagtcaccaataagacttccgcacctacgagagagattcaatatgtcgtaaagggctggtgtgacagcaggtttctcggaagtgcagctcctggtgcatcagctgctccaggtgctggttctggaagtggttcaggaatggacttgaatcaaagaaaggaaaaaagggccagcatgttggatgctgtggctccaggacagacctgtctgctgacacagtggaactgatagaaagaatggacagattggctgaaaaacaggcgacagcttccatgtcgatcgttgcgttaccgtctagcttccaggagagcaatagcagtgacaggtgcagaaagtattgcagcagtgatgaggacagcaacacgtgcattcatggtagtgctaatgccagtaccaatgcgactaccaactccagcactaatgctactaccactgccagcaccaacgtcaggactagtgctactaccactgccagcatcaacgtcaggactagtgcgactaccactgaaagtaccaactccagcactaatgctactaccactgccagcaccaacgtcaggactagtgctactaccactgccagcatcaacgtcaggactagtgcgactaccactgaaagtaccaactccaacactagtgctactaccaccgaaagtaccgactccaacactaatgctactaccactgctagcatcaacgtcaggactagtgcgactaccactgaaagtaccaactccaacactagtgctactaccaccgaaagtaccgactccaacactagtgctactaccactgctagcaccaactccagcactaatgccactaccactgctagcaccaactccagcactaatgccactaccactgaaagtaccaacgctagtgccaaggaggacgccaataaagatggcaatgctgaggataatagattccatccagtcaccgacattaacaaagagtcgtataagcggaaagggagtcaaatggttttcctagagagaaagaaactgaaagcacaatttcccaatacttccgagaatatgaatgtcttacagtttcttggatttcggtctgacgaaattaaacatcttttcctctatggtattgacatatacttctgcccagagggagtattcacacaatacggattatgcaagggctgtcaaaagatgttcgggctctgtgtctgttgggctggccagaaagtatcgtatcggaggatagcttgggaagcactagctgtggagagaatgctgcgaaatgatgaggaatacaaagaatacttggaagacatcgagccatatcatggggaccctgtaggatatttgaaatattttagcgtaaaaaggagagagatctactctcagatacagagaaattatgcttggtacctggccattactagaagaagagaaacaattagtgtattggattcgacaagaggcaagcaagggagccaagttttccgcatgtctggaaggcagatcaaagagttgtattataaagtatggagcaacttgcgtgaatcgaagacagaggtgctgcagtactttttgaactgggacgaaaaaaagtgccgggaagaatgggaggcaaaagacgatacggtctttgtggaagcgctcgagaaagttggagtttttcagcgtttgcgttccatgacgagcgctggactgcagggtccgcagtacgtcaagctgcagtttagcaggcatcatcgacagttgaggagcagatatgaattaagtctaggaatgcacttgcgagatcagcttgcgctgggagttaccccatctaaagtgccgcattggacggcattcctgtcgatgctgatagggctgttctacaataaaacatttcggcagaaactggaatatcttttggagcagatttcggagatgtggttgttaccacattggcttgatttggcaaacgttgaagttctcgctgcagataacacgagggtaccactgtacatgctgatggtagcggttcacaaagagctggatagcgatgatgttccagacggtagatttgatataatattactatgtagagattcgagcagagaagttggagagtga

SEQ ID NO: 23 - DNA, 2268 bp, Saccharomyces cerevisiae
atgtccggaaaagcttctacagagggtagcgttactacggagtttctctctgatatcattggtaagacagtgaacgtcaaacttgcctcgggtttactctacagcggaagattggaatccattgatggttttatgaatgttgcactatcgagtgccactgaacactacgagagtaataacaataagcttctaaataagttcaatagtgatgtctttttgaggggcacgcaggtcatgtatatcagtgaacaaaaaataggaagtgcagctcctggtgcatcagctgctccaggtgctggttctggaagtggttcaggaatgtctagagcagttggtattgatttgggaacaacttactcgtgtgttgctcatttttccaatgatagggtagagataattgcaaatgatcaaggtaataggaccactccatcgtatgtggctttcacagacaccgaaagattaattggtgacgccgccaaaaatcaagctgcaatcaatcctcataatacagtttttgatgcaaagcggttaattggtcgtaaatttgatgatcctgaagtgacgacagatgccaagcacttccctttcaaagttatatccagagatggtaaacctgtagtgcaagtagaatataagggtgaaacgaaaacatttacgcctgaggaaatttcttccatggttttaagcaaaatgaaggaaactgctgagaactatttgggaactacggtcaatgatgctgttgtaactgttcctgcatatttcaatgattctcaaagacaagccactaaggatgcaggaactattgcagggatgaacgttttacgtattatcaatgaacccactgcagcagcaattgcttatggcttggataagaaaggcagggctgagcacaatgtcctgatttttgatttgggtggtggtacttttgacgtctctttactttcaattgatgagggtgtttttgaggttaaggctaccgcaggagacactcatttaggtggtgaagattttgataataggttggtgaaccatttagccactgaattcaaaaggaaaacgaaaaaggacatctctaataatcaaagatcgttaagaagattgagaactgcggcagaaagagctaagagagcgctttcttcctcatctcaaacctcgatcgagatcgattctttatttgaaggtatggatttctacacttcgttaacaagggcaaggtttgaagagctatgtgctgatttattcagatccacattggaaccagtagaaaaggttcttaaagattcgaagctggacaagtcccaaattgatgagattgtgttagtcggtggatctaccagaatcccaaagattcagaaattagtttctgacttcttcaatggcaaagagcctaatcgttctatcaacccggatgaggctgttgcttatggtgcagccgttcaagctgccattttaaccggcgatcaatcaacaaagacacaagatttactattattggatgttgcgccattgtccctaggaattgaaactgcaggcggcataatgactaagctaattcctagaaactcaacgattccaacaaagaaatcggaaaccttctctacctatgcagataatcaacctggtgttttaattcaagtctttgaaggtgaaagaacaagaacaaaggataataacttacttggtaaattcgaattaagtggcattccgcctgctcccagaggtgtgcctcaaattgatgttacctttgatatcgacgctaatggtattcttaatgtgtctgctttggaaaagggtactggtaagagtaacaaaatcacgatcactaacgataaaggtaggctctcgaaggatgatattgataggatggtttctgaagctgaaaaatatagggctgacgatgaaagggaggcagaacgagttcaggctaagaatcagcttgaatcgtatgcatttactttgaagaataccataaacgaagcaagtttcaaagagaaagtaggtgaagatgatgcaaagagattagaaacagcgtctcaggaaaccattgactggttagatgcatcgcaggcagcctctacggacgaatataaggatagacaaaaggagttggaaggcattgccaatccaataatgacgaaattttacggtgctggtgccggcgcaggtcctggagcgggggaatccggtggattccccggatccatgcccaactcgggtgctacgggaggtggagaagatacaggtccaacagtggaagaggttgattga

SEQ ID NO: 24 - DNA, 2511 bp, Saccharomyces cerevisiae
atgctggcacaaacattcaaaaaaccacacagagccgttctagaacaggtatctgggaccacggtcttcatcagaaataagagaacaaagagcaagagctcactgtcacctttggcacaaagggtcgtcacgcagttgagtgtgatgtctgcaagcagaaagcagcccaagttgctgaagctggcgcgtgaagacctgattaaacatcagaccattgagaagtgttggtcaatttatcagcagcaacaacgggagcgcagaaatttacagttggaattacaatataagagcattgagagatctatgaaccttctacaagaactcagccctcgtctgtttgaggctgccaatgcttccgagaagggcaagcgattcccgatggaaatgaaggtgcccactgacttccccccaaatacgttatggcattataacttccgaaaaggaagtgcagctcctggtgcatcagctgctccaggtgctggttctggaagtggttcaggaatgctgcgtgtaacaaccttggcgtcttcgtgtacttcatttcccttacaggtcctcaggaggcggttgaccatatcttctttgacaagcttccaacccacaaccaagacacaggtcgtggtcatcggtgctggacatgcaggctgcgaagctgcagctgcgtcatctaggactggtgcgcatactactctcattacaccatcgttaacagatattggtaagtgttcgtgcaacccctctattggtggagtgggtaagggcatccttgtaaaggaaatcgacgctctcgatgggctgatgggcaaagtaactgatctcgctggagtgcaattcaaaatgctgaacagaagcaagggtcctgctgtgtgggggcccagagcccagatagacagagagttatataagaaatacatgcaaagggaactttccgacaagaaagcacaccccaacttgtctctgctgcagaacaaagttgctgacttgatcttgtatgaccccggatgtggccacaaggtcatcaaaggtgtggttctggatgacggtacccaggttggggcagatcaggtcataatcactacaggtacgtttctcagtgcagaaattcacatcggcgacaagcgtattgcagcaggaagaattggcgagcagccaacatatgggatcagcaatactctacaaaatgaggtgggctttcagttagggcgtttgaaaacaggcactccggctaggctggccaaggaatccattgatttcagcgctctggaggtccagaagggagatgcgttgcctgtccctatgagttttctgaatgaaaccgtgtcagtcgaacccacgaagcaactggattgctttggcacacataccacacctcaaatgcacgactttttgcgcaataacttgcatcaatccattcatattcaggacacgaccatcaaaggcccccgctattgtccctccatcgaagctaagattctaaggtttcctgatagatcttcccataagatatggttggaaccagaaggtttcaactccgacgtcatttatccgaacgggatatccaattctatgcctgaggatgtccagttacaaatgatgaggctcatcccgggcatggcaaacgttgagatcttgcagccggcatacggcgtggaatacgactacgtagacccacggcaattaaagcctagcttggaaacaaaattggtggatggactattcttggccggacaaataaatggtactacaggctacgaggaagccgctgcacaggggatcattgcaggtatcaatgcaggattactatcgcgccaagaacgggagcaattggtcttgaaaaggtccgaagcgtacattggtgtgctcattgacgatctaatcaataatggcgtcatagaaccatatagaatgtttacttccagatcagaattcagaatcagcgtaagagccgataacgcagacttcagactgacgcccattggtgctcaactagggattatatctcctgtccgtttaagtcaatattcaagagacaagcacctatatgatgaaacaatacgggcgcttcaaaatttcaagctaagctctcaaaaatggtctagcttactacaggctaatatcgcgccacaggctgaaaacagatctgcttgggaaatattcagattcaaagatatggatctacataaactctacgagtgcattcccgatttacccattaatttgctggacatcccaatgcatgttgtcaccaaaattaacattcaaggtaaatacgaaccttacattgtcaaacagaaccagtttgtgaaggcatttcaggcagacgaaaatatgctgttgccgcaagattacgattaccgtcagttacccacgctttccactgaatgcaaactactcttgaaccgcgtacagccattgaccataggccaagcaagacggattcaaggtatcactgcggcagccctatttgaactctaccgtgtggcacggaagccaagccaaccagtcatgtaa

SEQ ID NO: 25 - DNA, 2568 bp, Saccharomyces cerevisiae
atgaccttgtggccacatccggggtcatacaagatcaagtcagcaactttgttctgcagcagagacaagttggggtgtgctttcttgtcggaaagttccctttgcatgtatttcttatataactctctgtctatctgggctctgggcccccacacagcaggacccttgcttctgttcagcattttgaattgcactccagcgagatcagttactttgcccatcagcccatcgagagcgtcgatttcctttacaaggatgcccttacccactccaccaatagaggggttgcacgaacacttaccaatatctgttaacgatggtgtaatgagagtagtatgcgcaccagtcctagatgacgcagctgcagcttcgcagcctgcatgtccagcaccgatgaccacgacctgtgtcttggttgtgggttggaagcttgtcaaagaagatatggtcaaccgcctcctgaggacctgtaagggaaatgaagtacacgaagacgccaaggttgttacacgcagcatcgttctttggggcgttggaagtgcagctcctggtgcatcagctgctccaggtgctggttctggaagtggttcaggaatgcttaaatctggtagactcaactttctcaagttgaatatcaattcacgattactatactcaacgaaccctcaactgactaagaaggtcattggtatcgacctgggtaccacgaatagtgctgttgcatatatccgtgattctaacgacaaaaaatcagctacaatcatagaaaatgatgaaggacaacgaaccacaccatctatagttgcctttgatgtcaaaagctcgccacagaataaagatcaaatgaaaactcttgtagggatggcagctaaaaggcaaaatgctattaattctgaaaacactttctttgctacaaagagacttattggccgtgcattcaacgacaaggaagttcagcgagatatggctgttatgccatataagattgtcaaatgtgagtcaaatgggcaagcctatctcagcacgtctaatggtctcattcaatcaccaagccagatagcatctatattactgaaatacctgaaacaaacttcagaagaatacttaggcgaaaaggttaatttggcagttattacagttccagcatattttaatgattctcaaaggcaagccacaaaagatgccggcaagttagctggcctaaatgttttgagagttattaacgaaccaactgcggccgccttaagctttggaattgatgataagaggaataatggattaattgcagtttacgatttgggtggtggtacatttgacatatccatcttggacattgaagatggcgtgtttgaggttcgtgctactaatggtgacacgcatttaggtggagaagattttgacaacgtcattgtaaactatattatagataccttcattcatgaaaaccctgaaattacacgggaagaaattacgaagaacagggagacaatgcaaaggttaaaagatgtttctgaaagagctaagatagatttatcccatgtgaagaaaacttttatcgaacttccatttgtatacaaaagcaaacatctacgagtgccaatgacagaggaagagctggataatatgactttgtcattaatcaacaggactatcccacctgtgaagcaagcattgaaagatgccgatatcgaaccggaggatatagatgaagtaatccttgttggtggtatgacccgtatgccaaagattagatctgttgtaaaagatctttttggtaagtctccaaattctagtgttaacccagatgaaacagttgctttaggagcagctattcaaggtggtattctatccggtgaaataaagaatgtcttacttttggatgtgacaccattgacattagggattgaaacatttggaggagcgttctcacccttgatacctagaaatacgacagttccagtaaaaaaaacagagatatttagtactggtgttgatgggcaagcgggtgttgatatcaaagtttttcagggtgaaagagggttagtgcgtaacaacaagttgattggtgatttgaaacttacaggaatcacccctttgcctaaaggcattccccaaatatatgttacttttgatatcgatgcggatggtatcatcaacgtatctgccgctgagaaaagtagtgggaaacaacaatccattactgtaataccaaattctgggttaagcgaagaggaaattgcaaaacttattgaagaagcaaatgcaaatagggcacaagataacttgatcaggcaaaggttagagcttatctctaaggctgacattatgataagtgatactgagaatttatttaaaagatatgaaaaactgatttctagcgaaaaagagtattctaatatcgtagaggacatcaaagctctgagacaagctataaagaattttaaggctaacgaaaatgacatgtcaattgatgtaaacggaataaaaaaagctacggatgcgctacagggtagggcattaaaattattccaaagcgcaacaaaaaaccagcagaatcaaggtaaataa

SEQ ID NO: 26 - DNA, 1398 bp, Saccharomyces cerevisiae
atgcagattttcgtcaagactttgaccggtaaaaccataacattggaagttgaatcttccgataccatcgacaacgttaagtcgaaaattcaagacaaggaaggtattcctccagaccagcaaagattgatttttgccggtaagcaactagaagatggtagaacgctgtcggactacaatattcaaaaggagtccactcttcaccttgtcttgaggttgaggggtggtaacggaagtgcagctcctggtgcatcagctgctccaggtgctggttctggaagtggttcaggaatgccaggccagataatcagcattccgtttttgtcgcagaacgaggacatggataaatacttgttggagtaccgcagtttgaagctccttcatcagtccagtaattccttccagtctcacaatgcgccctcccaccagtcgaactaccacccccattacaatcacatgaaatacaacaacactggtagctattactattacaacaacaacaataacagcagtgtaaacccacataaccaagctggtctacaatccattaacagatctattccatcggccccgtacggggcttacaaccagaacagagctaatgacgtaccatatatgaatacccaaaagaaacaccacagatttagcgctaacaataatttgaaccagcaaaaatacaagcaatatccccagtatacgtccaatccaatggttactgcacatctgaagcaaacgtaccctcaactgtactacaatagcaacgtcaatgctcacaacaacaacaacaacagcaacaacaacaacaacaacaacaacaacagcaacaacaacaacaatctttacaaccagacgcagttctccacgaggtacttcaactcgaactcctctccctcgttgacttcttccacttctaactcatcctctccatacaaccaaagcaccttcgaatacattttgccgtcaacttcggcagcttccacaaatttatcgtcgtcatcatcaaacaactctatgcacaccaacccaaccactgcaacatcgacatccgccgatttaatcaatgatttacccgtgggccccacgtccagttcgcttatctcggatctacattctccaccaactgtatctttcctaccagcaagccaaaccctgctcatgtcctccaccacatctagctctattggcaccaacataaacccaccgcaacattcaccatccccatcgcaaagggaggatttttcgacggcaccagtgaacatgtcttcgtccgcatcactcttgatgaatgattcttctttaggatgggggtctaaccacatgaacgtatcttcatcctctcaaccagcatcatcaagaccctttggcatttggaatactgacatgagcgtttggagttga

SEQ ID NO: 27 - DNA, 2328 bp, Saccharomyces cerevisiae
atgtggagacgtcggcgcgagccctgggaggagttatcttttcttcttaacagcttatcaccccggaattggtttatccggagatggggtcttatggctggaagaggccagcacctttgctggctccggtgcgcttgtgacggcccgggaagtgcagctcctggtgcatcagctgctccaggtgctggttctggaagtggttcaggaatgtcgtttttgccactaaggtctaggtcacgatcaggcgctcctcattgggtatacatcatcttatatcacatctttacgataccgaagatatattcactgccgttgttatccggatcacacgtactcaattctagggatgttgccgattccggccatagcgtaggtgatgaggcaagcgttaccacgtactatattatctctatcatcctagtgctgctgggtggtgtatttgcaggattgacgctggggttgatgggtcaagatgaagtctacctgaaggtaatcagcacttcaggctcgaattctgaaaagaaactggccaagcgggtgcttgacctaatatctagggggaagcattgggttctagtcacactgctgctttctaatgttataaccaacgaaacattgcctattgttttggacaggtgtcttgggggtggttggcaggctgtagtgtcgtcaactattctaattgtgatcttcggtgaaattattccgcagagtgtctgtgttaaatacgggctgcaagttggggcattcttctgcccctttgttcttgtactgatgtatctgatgtacccagtcgcatatccgatcgcgactctcctggactatatgctgggtgaagatcatggtacgatgtacaaaaaatccggcttaaagactttggtcaccttgcataggaccatgggggtggaacggttgactaaagacgaagttacaatcatctctgctgttttggatctaaaggcaaagagggttgaggaaatcatgactccgattgaaaacgtgttcacaatgagtgccgataccatcctagacgataaaactgtcgaaaaaatcttcaactcagggttttctagaatcccgatttttttgcccaatgaaccaaacaacttcatcggcatgttacttgtcagggtgcttatctcctacgatcctgatgactgcctcccaatctcccacttccccctagccacgttgccagaaacttccccgaacacatcttgtttgaatattctgaattacttccaggaggggaaagctcacatgtgcgtcgttagtaaagagccgggctcctcgcatggcgctattggtgttttaactttggaggatgtcattgaagaattgatcggtgaagaaatcgtggacgagtctgatgtctttgtggacatgcatcagcatattatgagacaacaaccggggcccttgagcaaaaggcacattacttcctatttgcatcatttgtacactagctctcacaaggagcacaaagctgctgaccaagctgatgaatcgtctccactcttgtctccatccaattctaatcacccatccgagcacccacagcaagatttgaataataagtcttggaagcagaagtcaaatgatggttacgacaggtccaacgctgtattgtctccaactccacaagtgacggaacatggcaccatcataccttcaaatctagcgtccaacccgttgaacgtaaataaatcttttgttaccattaaaaagcctgccaatgttccgaaaatcattactacacacactcctcattctagcaaagagccttctccagcaccacactcaaatgataaatcactctccgccgaagaacaacaactattaagtgatcatgcagagctatctcgccaagctgttctccatactcaacggtcgggtcaaccaactcaagttactacctcgactaaaaccacgagaaatagccctgatagtatatcaattccaaattctggcgcgaatcacggcaacgaaaatcaaaacgttacaatctcaacctcttaccaaaatacgaagaatggtattgtggaatctgtcatcacagtcaaaggtgttccaaaaaccatcattggccccgcaaaagattgggacgaatccaaaagtgaatatggaaacgagaatatcaatcaagagaattctaatcgaagtgacgatagagaaagttcaagttcaaatgcaagtttattttccagtattaagaataaatttaagaacgaaaacgctaacaacaatgatcgttctaatttcaccgactctttgtcaagaacttccaattatgatgccaacggctcctcgtcgaccataaaaagatga

SEQ ID NO: 28 - DNA, 2573 bp, Saccharomyces cerevisiae
atggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagggaagtgcagctcctggtgcatcagctgctccaggtgctggttctggaagtggttcaggaatggctagaggaccgtatgttgatttccacctaaaaaaatgaagagttggcaaaacaagataatagttttctttgaagatgggtaccctctcatgattggtacaagtgatttgcaccaaagtgacgatgcggactaaagaaagaatataagagttgtgtttatctatctggaagatagaattctgatgagaaactttatccttgttaagtaacagataagcattgcgggatatttttactaacaagagtacgtttaataatgttaatacgatttttcatatagaaagaagcatctaaagagattagcagctccacaccattggttattggacaagttgtccggttgttacgccccaagaccatctgctggtccacacaaattgcgtgaatccttgccattgattgtctttctaagaaacagattaaagtatgctttgaacggccgtgaagtcaaggctatcttgatgcaacgtcacgtcaaagttgacggtaaggttagaactgacaccacctacccagctggtttcatggacgtcatcactctagatgccaccaatgaaaacttcagattggtctacgatgtcaagggtagattcgctgtccaccgtatcaccgatgaagaagcctcttacaaattgggtaaggtcaagaaggtccaattaggtaagaagggtgttccatacgttgttacccacgatggtagaactatcagatacccagacccaaacatcaaggtcaatgacactgttaagattgatttggcctctggtaagattactgatttcatcaagttcgatgccggtaagttggtttacgttactggtggtcgtaacttgggtcgtatcggtactatcgttcacaaggaaagacacgatggtggtttcgatttggttcacatcaaggactccttggacaacactttcgtcactagattgaacaatgtcttcgtcattggtgaacaaggtaagccttacatttctttgccaaagggtaagggtatcaagttgtctattgctgaagaacgtgacagaagaagagctcaacaaggtttgtaa

SEQ ID NO: 29 - DNA, 3027 bp, Saccharomyces cerevisiae
atggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagggaagtgcagctcctggtgcatcagctgctccaggtgctggttctggaagtggttcaggaatgctgctggacgtgaacacaaatcacacactaatgcacgatgctcatgtgcatgaacattgcctcatcaaaagcatacgtgatgatggcgcattgcactcatggagcgactcatcaaaggtattttatcccaagtcattttacgctaccgctactaataagaagaataacaagttagccagcgccagcatgaacaagaccgccacaagtaataggacggtgagcgatgagatttatttccactccactaagccgcagttcgatggtcaaggaagcgctgaacgtactagaacactaaccaagaggaatagcttcaagaggactagaatactgaaggctcgagacgattccgaactgctgaacgaaaatcgctcatctttgatgaccccgtccttaagctcggtcatgtcgcaagttaggaaaacaaattccgccaagacgttatcgggcgaatgccccatacatgagggccacttaacacagagcataaagaggaagttctccgaggaagctcaaagcgactgttcttcattgagctcctctaaacttcatcccttgacagatgatattgctgacgctgtcgatttgcagacccccgcgattggcgatgaggtactggctgagccggtcgtgcccaaaatgaaaataataaacataaatgatctcgatttgttcgacgactgggaggttaaggatttagtcgatatctttcctcccgtatacgaacggcgtccgcgatcgtcctctgccctttcactggtttctgcgtcgtccgatgccaaacttcgtccgacctctgtggacttccaaatcatcgacaagaaaggcggcaagacttcaagaaggaagagtaggagcaaatcgactacagaaaacatgatttacgaaaatgacctggtagaattagaacaatggccatctgcatcaccatcgcccgagaccgacggttcgattgcatctagcgagctcttgcccaataaaagaataagacaaaaaagtttgaataccaatttcctaaagttatactctattgaaacatcatgtaaaaggaagagtattttacccgaagtcgaagtagatgaccatctgttgaagcagctaacgtattccgaaattcggtctttggaaatcaaaaaggagccaaatgtctctacgaacgatattaagcttgccctaattactaggaaaaaattatggtctgacatggtccatgaaacaagaaatgatctttttggcgattctaccccctggaatttgcactttgttgcaacgacaagcaatacggaaccttcgcaaggccgtgaatccgcaagcgaacatgcaacggcggatttgaaaagttctttggtccgcgtacactcagacgtcaagccatggttcaacaatggcggcacaatgctcaaaccatgcggaaaactaaatttaggcaaagtcaccaataagacttccgcacctacgagagagattcaatatgtcgtaaagggctggtgtgacagcaggtttctctga

SEQ ID NO: 30 - DNA, 1833 bp, Saccharomyces cerevisiae
atggtcactcaattaaaatccgcttctgaatacgacagtgctttagcatctggcgacaagttagtcgttgttgacttttttgccacatggtgtgggccatgtaaaatgattgcaccaatgattgaaaagtttgcagaacaatattctgacgctgctttttacaagttggatgttgatgaagtctcagatgttgctcaaaaagctgaagtttcttccatgcctaccctaatcttctacaagggcggtaaggaggttaccagagtcgtcggtgccaacccagctgctatcaagcaagctattgcttccaacgtaggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 31 - DNA, 1965 bp, Saccharomyces cerevisiae
atggactcgtactcaataacaaacgtaaaatacctggatccgactgaattgcatcgttggatgcaagaaggacacactactacgctgagggagcctttccaggtagtggatgtgcgaggctcagattatatggggggccatatcaaggacggatggcactacgcctattcgcgccttaagcaggatccggagtacttacgtgagctaaagcacagattgttggaaaagcaagcggacggccgcggagcgctgaacgtgattttccattgtatgttatcgcagcagcgcggaccgtctgcagcgatgctgctgcttcggtcgcttgacacggcggaactttctcgctgtcgtctatgggtgttgcgtggggggttctcgcgctggcaatccgtatacggtgacgacgagagcgttacggcgggttacctacccgatctgtggcgtggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 32 - DNA, 2007 bp, Saccharomyces cerevisiae
atggtgatgctccattctaaaaacgttaaagggtttctggaaaacactttgaaaccgtatgatttgcattcggtagacttcaagacatcgtctttgcaatcgtctatgattataaccgccactaatgggggtatactgtcctatgcgacgtcaaacaacgatgtaccgaaaaattccataaacgaaataaactcggtcaataacttgaaaatgatgagcttattgattaaggataagtggtcagaggatgaaaacgatactgaggaacagcactccaatagctgttaccctgtggaaatcgactcctttaagacaaaaatatatacttacgaaatggaagatttacatacctgtgtcgcacagatacccaatagcgaccttttgctattgttcattgcggaaggtagcttcccttacggactactggtaattaaaattgaaagagctatgagagagttgactgatttgtttggctacaagctaggtggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 33 - DNA, 1827 bp, Saccharomyces cerevisiae
atggcaggggatagtataagcgctgacggcactggcgtccatccagttgaactgtcggtgtattcagtattgtccaccgatttagacggactgtatcaatcgatcaatgaattacgcgagtcgcaagcactactcatccttatgcttcggaaggttcgcgataaacttcgaagagaaggtcaagtcctttatgacccagaaccattcaaaccaaccatggataaactggctgacttatctgcccgtgtgcgcattctctcacaaagatacgaggagcttcaggggaatgctagagccctcaacaacggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 34 - DNA, 2895 bp, Saccharomyces cerevisiae
atgggtaaagagaagtctcacattaacgttgtcgttatcggtcatgtcgattctggtaagtctaccactaccggtcatttgatttacaagtgtggtggtattgacaagagaaccatcgaaaagttcgaaaaggaagccgctgaattaggtaagggttctttcaagtacgcttgggttttggacaagttaaaggctgaaagagaaagaggtatcactatcgatattgctttgtggaagttcgaaactccaaagtaccaagttaccgttattgatgctccaggtcacagagatttcatcaagaacatgattactggtacttctcaagctgactgtgctatcttgattattgctggtggtgtcggtgaattcgaagccggtatctctaaggatggtcaaaccagagaacacgctttgttggctttcaccttgggtgttagacaattgattgttgctgtcaacaagatggactccgtcaaatgggacgaatccagattccaagaaattgtcaaggaaacctccaactttatcaagaaggttggttacaacccaaagactgttccattcgtcccaatctctggttggaacggtgacaacatgattgaagctaccaccaacgctccatggtacaagggttgggaaaaggaaaccaaggccggtgtcgtcaagggtaagactttgttggaagccattgacgccattgaacaaccatctagaccaactgacaagccattgagattgccattgcaagatgtttacaagattggtggtattggtactgtgccagtcggtagagttgaaaccggtgtcatcaagccaggtatggttgttacttttgccccagctggtgttaccactgaagtcaagtccgttgaaatgcatcacgaacaattggaacaaggtgttccaggtgacaacgttggtttcaacgtcaagaacgtttccgttaaggaaatcagaagaggtaacgtctgtggtgacgctaagaacgatccaccaaagggttgcgcttctttcaacgctaccgtcattgttttgaaccatccaggtcaaatctctgctggttactctccagttttggattgtcacactgctcacattgcttgtagattcgacgaattgttggaaaagaacgacagaagatctggtaagaagttggaagaccatccaaagttcttgaagtccggtgacgctgctttggtcaagttcgttccatctaagccaatgtgtgttgaagctttcagtgaatacccaccattaggtagattcgctgtcagagacatgagacaaactgtcgctgtcggtgttatcaagtctgttgacaagactgaaaaggccgctaaggttaccaaggctgctcaaaaggctgctaagaaaggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 35 - DNA, 1860 bp, Saccharomyces cerevisiae
atgacaagcaaacgggaaaagtcactggatcacacattgtaagtagaagcagtttttcaatgggaagaccgcactgcatagtttactaactatttaaactttccaaacattagagaactaaagataccgtttgaaacggagcgacaagcgaccatagcaaccaaagtcctatctccggacccgattttgaagccacaagattttcaagtagactacagttccgagaaaaatgtcatgctagtccagttcagaagcattgatgatagggtgcttcgagtgggagttagcagtatcatagacagtatcaaaaccattgtggaagccatggacgttctatcaggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 36 - DNA, 1953 bp, Saccharomyces cerevisiae
atgggcaagaaagcacacggaggaaagatgaaacctgagatcgacgaaaatggtactctgctagtaccgccaccaaggacgattgcgaaccaggaccatttccatagattaaactacctctaccaaatatccgcttaccaaacaagagcaagacagaaagcaagaacagacgcacatacgcctttggcacgcaattatatcaaatcaatggacctaattagtaagaaaaccaagacatcactgcttcctacgataaagagaacaatttgtaaaaaatgccatcggttgttatggaccccaaaaaaactggaaatcacatccgacggagcgctttcggtaatgtgtgggtgcggtaccgttaaacgttttaatattggcgccgatcctaattacaggacctactcggagcgggagggtaatctactaaattctggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 37 - DNA, 1890 bp, Saccharomyces cerevisiae
atgaaactaccggtagcacagtacagtgcaccagatggtgtggaaaaaagttttgcaccaatacgcgatgaccctcgatacatgaccacagagggaaggacaactgggcccagtgaccatgtgctaaacgctggccaaatcgatagagacaaaccttcagaaccggaacgcacgaaagatggctcacaactgacatacttaggccagctgcgcacgcagctgacggggctacaggacgatattaacgagtttttgacaggaagaatggaattggcaaaaaataagaagaaagccggcgcagacgagaagcggatccaggaagagattaaccagctattagatggtggtgacggtgacgaagatgctgttggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 38 - DNA, 773 bp, Saccharomyces cerevisiae
atgtcctctgtggaatcttcccccatctcgcgctatgaagacgaggtcttccctctttcgttttcaaacgttgctttcgagccccctatgctctcgcatagcccggacagatcgacttatgccgatgacttttctcaatcttaccagcaagaattgctaacttttccgctatcgtacccgattgtcgatgagtcagaatgcacgcacactaaagataagacggacagcaacataataacgagtactgaagacgattgcatgttcgatatggaatttaacggcaacgccgccagtgcagttgctgctgctagtaaggaatctaactctgcctctgggtttgcctttgcaagtaacgatgcctttgccaatgtcgcacaacagaactacagactgtggttgtcatcggtaggaagtgcagctcctggtgcatcagctgctccaggtgctggttctggaagtggttcaggaatggttcagtacgctccctttctattaggaaagtatgttcattcttcatacgctattctatttttttttttttcacacttattcttttactaacgcatagttaaccatttgctgtttcgaagaggcaacatcaaacaagtcgatgtgctctttcccaagctggtctctattgcagattttctgatccgttattggcaattatggtaggctgtctcagctactatgtgtacgaaaggaaaatggggcgtccacaaggtcatcatttacacgagctcataaagaagcgatgggacgatcgcaaataa

SEQ ID NO: 39 - DNA, 2130 bp, Saccharomyces cerevisiae
atgtcccaaggtagaaaagctgcagaaagattggctaagaagactgtcctcattacaggtgcatctgctggtattggtaaggcgaccgcattagagtacttggaggcatccaatggtgatatgaaactgatcttggctgctagaagattagaaaagctcgaggaattgaagaagaccattgatcaagagtttccaaacgcaaaagttcatgtggcccagctggatatcactcaagcagaaaaaatcaagcccttcattgaaaacttgccacaagagttcaaggatattgacattctggtgaacaatgccggaaaggctcttggcagtgaccgtgtgggccagatcgcaacggaggatatccaggacgtgtttgacaccaacgtcacggctttaatcaatatcacacaagctgtactgcccatattccaagccaagaattcaggagatattgtaaatttgggttcaatcgctggcagagacgcatacccaacaggttctatctattgtgcctctaagtttgccgtgggggcgttcactgatagtttgagaaaggagctcatcaacactaaaattagagtcattctaattgcaccagggctagtcgagactgaattttcactagttagatacagaggtaacgaggaacaagccaagaatgtttacaaggatactaccccattgatggctgatgacgtggctgatctgatcgtctatgcaacttccagaaaacaaaatactgtaattgcagacactttaatctttccaacaaaccaagcgtcacctcatcatatcttccgtggaggaagtgcagctcctggtgcatcagctgctccaggtgctggttctggaagtggttcaggaatgaatcagtgcgcgaaggacataactcatgaagcctccagtatacccatcgatttgcaagaaagatactcgcactggaagaaaaacactaaactactttatgattacctaaacacgaattcaacaaagtggccgtccttaacgtgccagttctttcctgatttagataccacttcggatgagcatcgcatcttgttatcctcatttacatcttcccaaaaacctgaagatgagaccatatatattagcaaaatatccacgttgggtcatataaaatggtcatctttaaataatttcgacatggacgaaatggaattcaaaccggagaactcgacaaggtttccctccaaacacttagtaaatgacatcagtattttcttcccaaacggggaatgcaatagggcaagatatttgcctcaaaatccagatattatagccggcgcctcttcagatggtgcaatctacatattcgatagaacaaaacacggctctactagaataagacagtccaaaatttcacatccctttgagacaaagctgtttggttcacatggtgttattcaagacgtggaggcaatggatacttcttcggcagatataaatgaggcgacttctttagcctggaacttgcagcaggaggcccttttactttcttctcactccaacggccaagttcaagtttgggacattaaacaatattcgcatgagaaccctataatagatttacccttagtgtcaataaacagcgacggaacagcggtgaatgatgtaacttggatgccaacacacgattccctctttgctgcttgtactgaaggaaatgcggtctccctattagatctgaggactaagaaagagaagctccagagtaaccgtgaaaaacacgatggtggagtaaactcctgtagatttaactataagaactctttaattctagcatctgcagattcaaatgggaggctaaatttatgggatattagaaacatgaacaaaagcccaatcgctaccatggagcacggtacttccgtttcaactttagaatggagtccaaatttcgatactgtattggcaacggctggccaagaagatgggttagtcaagctatgggatacctcctgcgaagaaactatatttacccatggtggtcatatgctcggtgtgaacgacatttcgtgggacgctcatgacccttggttaatgtgcagtgtggcaaatgataattcagttcacatatggaaacctgcaggaaaccttgttggacattcgtga

SEQ ID NO: 40 - DNA, 1992 bp, Saccharomyces cerevisiae
atgtctgacgaagaacatacctttgaaactgctgacgctggttcctccgccacctacccaatgcaatgttctgccttgagaaagaacggtttcgttgtcatcaagagtagaccatgtaagattgtcgacatgtccacttctaagactggtaagcacggtcacgctaaagtccatttggttgccattgatatcttcactggtaagaagttggaagatttgtctccatctactcacaacatggaagttccagttgtcaagagaaacgaataccaattgttggacattgatgacggtttcttgtctttgatgaacatggacggtgacactaaggatgatgtcaaggctccagaaggtgaattgggtgacagtttgcaaactgcttttgatgaaggtaaggacttgatggttaccatcatctccgctatgggtgaagaagccgccatctccttcaaggaagctgctagaaccgatggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 41 - DNA, 1929 bp, Saccharomyces cerevisiae
atgtcctctgtggaatcttcccccatctcgcgctatgaagacgaggtcttccctctttcgttttcaaacgttgctttcgagccccctatgctctcgcatagcccggacagatcgacttatgccgatgacttttctcaatcttaccagcaagaattgctaacttttccgctatcgtacccgattgtcgatgagtcagaatgcacgcacactaaagataagacggacagcaacataataacgagtactgaagacgattgcatgttcgatatggaatttaacggcaacgccgccagtgcagttgctgctgctagtaaggaatctaactctgcctctgggtttgcctttgcaagtaacgatgcctttgccaatgtcgcacaacagaactacagactgtggttgtcatcggtaggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 42 - DNA, 516 bp, Saccharomyces cerevisiae
atgtggagacgtcggcgcgagccctgggaggagttatcttttcttcttaacagcttatcaccccggaattggtttatccggagatggggtcttatggctggaagaggccagcacctttgctggctccggtgcgcttgtgacggcccgggaagtgcagctcctggtgcatcagctgctccaggtgctggttctggaagtggttcaggaatgtctagtgaaagagcctgtatgctgtgtggcatagtgcagaccacaaatgagtttaatagagatggttgtcccaactgtcagggtatttttgaagaggcaggtgtttctacaatggaatgtacgtcgccttctttcgagggcctcgtaggaatgtgtaagcctactaagtcgtgggtagcaaagtggctgagcgtagatcatagtatagctggtatgtacgccatcaaggtcgatggtagactaccagctgaggttgtggagctgttgcctcactacaaaccgagggatggcagtcaagttgagtaa

SEQ ID NO: 43 - DNA, 2151 bp, Saccharomyces cerevisiae
atgatgagtcaagtatcgcattcccaagaaggatccgggcgattttggaacaagtttaagtcgtcaaccaaatcgttatctacatcgttggcacatttatccattaaagcagaaaaagatggtgatactgtaaatactacattggtccataaagggcttgtgaaattctatgaaaatcagcatcctttccaggggttcccaggatggttgggggagaaggaagatttaccgaacgaacgtaaaatattagatactcaagtgaagcatgatatgaagaagcaaaactcgcgtcatttctcgccatccttttctaacagaaggaaggcttcttcagaagatcctatgggtacaccttcttcaaacgggaacacaccggagtacacgcctgcgagtaaatcgtttcaagatatatacaataatcatacaagctcctctagcgcgacaccgagaagagcttcatcacggccgactagaccttcagcaggccaagaattcagggcaagtctcggtcgaagtaaaacgtcgaacagtttcaacacctccagcacgccaacgccgccaccagacgcaagtagtggagtaatggcaatgaaggacagactaaagagacgcaataacgattatggatttggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 44 - DNA, 2235 bp, Saccharomyces cerevisiae
atgtcccacaaattaacaatcctgccatttctgattaagttcacgcccaagtttccacaatccattgatcacgacgagcatggtctaaacgtttatgcctttgatctggaccatacaattatcaaaccaaagtcccccaatataagttttagtagaagcgcaagtgattggcagtttattaattttaactccaagaaatccaccctggattacctgtgtaatatcattgataatgatcccacggccgtcatagtcatattttctaaccaaggtggtgtcatcaccgtcccaagaacttctaaaagttgcaccaagtacactaataaaattttgctatttttaaaggcaatcaaaaacgatgagagaggagaaacgttatcacacaggttatggctatatgcagcacctaaaaggccgaaaacttttgcagcaaatcatagtaagatcacattcgcaagcttaggtgaaagttataacaatgatcctaacatattcgaaaaagttcgaaaaccaatgacaggaatggtagagttttttaaaagggacctggaaagtgcatacagggtttcagaacaaatttctcccatcaagttgaattggatatattattgcggtgacgctgctgggaggaaaaaggacttcagtgattctgacataaagtttgctgaaaacttgcacgttgaattcaagtaccctgaggaaatatttcacgggggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 45 - DNA, 2256 bp, Saccharomyces cerevisiae
atgaatcagtgcgcgaaggacataactcatgaagcctccagtatacccatcgatttgcaagaaagatactcgcactggaagaaaaacactaaactactttatgattacctaaacacgaattcaacaaagtggccgtccttaacgtgccagttctttcctgatttagataccacttcggatgagcatcgcatcttgttatcctcatttacatcttcccaaaaacctgaagatgagaccatatatattagcaaaatatccacgttgggtcatataaaatggtcatctttaaataatttcgacatggacgaaatggaattcaaaccggagaactcgacaaggtttccctccaaacacttagtaaatgacatcagtattttcttcccaaacggggaatgcaatagggcaagatatttgcctcaaaatccagatattatagccggcgcctcttcagatggtgcaatctacatattcgatagaacaaaacacggctctactagaataagacagtccaaaatttcacatccctttgagacaaagctgtttggttcacatggtgttattcaagacgtggaggcaatggatacttcttcggcagatataaatgaggcgacttctttagcctggaacttgcagcaggaggcccttttactttcttctcactccaacggccaagttcaagtttgggacattaaacaatattcgcatgagaaccctataatagatttacccttagtgtcaataaacagcgacggaacagcggtgaatgatgtaacttggatgccaacacacgattccctctttgctgcttgtactgaaggaaatgcggtctccctattagatctgaggactaagaaagagaagctccagagtaaccgtgaaaaacacgatggtggagtaaactcctgtagatttaactataagaactctttaattctagcatctgcagattcaaatgggaggctaaatttatgggatattagaaacatgaacaaaagcccaatcgctaccatggagcacggtacttccgtttcaactttagaatggagtccaaatttcgatactgtattggcaacggctggccaagaagatgggttagtcaagctatgggatacctcctgcgaagaaactatatttacccatggtggtcatatgctcggtgtgaacgacatttcgtgggacgctcatgacccttggttaatgtgcagtgtggcaaatgataattcagttcacatatggaaacctgcaggaaaccttgttggacattcgggaagtgcagctcctggtgcatcagctgctccaggtgctggttctggaagtggttcaggaatgcagggaaataaatcaactataagagagtataagatagtagttgtcggtggaggtggcgttggtaaatctgctttaacaattcaattcattcaatcatactttgtggacgaatatgaccctactatcgaagattcttacagaaaacaagttgtcatcgatgacaaagtatccattttggacattctagatactgctggacaagaagagtattctgcgatgagagaacagtacatgaggactggggaaggtttcctactggtctattccgtcacctctagaaattcctttgatgagttactgtcttattatcagcaaattcaaagagtaaaagattctgactacattcctgtagtcgtggtaggtaacaaattggaccttgaaaatgaaagacaagtctcttatgaagacgggttacgcctggccaagcagttgaatgcaccctttctagaaacgtctgcgaaacaagccatcaacgtagacgaggccttttatagccttattcgtttggtaagggacgacggtgggaaatacaatagcatgaatcgtcaactggataatacgaatgaaataagagattcggagctaacctcatctgcaacagcggatagagaaaaaaagaacaacgggtcttatgtactcgataattctttgaccaatgctggcactggctccagttcaaagtcagccgttaaccataacggtgaaactactaaacgaactgatgaaaagaattacgttaatcaaaacaataacaatgaaggaaataccaagtactccagtaacggcaacggaaatcgaagtgatattagtcgtggtaatcaaaataatgccttaaattcgagaagtaaacagtctgctgagccacaaaaaaattcaagcgccaacgctagaaaagaatctagtggtggttgttgtataatttgttga

SEQ ID NO: 46 - DNA, 2013 bp, Saccharomyces cerevisiae
atggactcgtactcaataacaaacgtaaaatacctggatccgactgaattgcatcgttggatgcaagaaggacacactactacgctgagggagcctttccaggtagtggatgtgcgaggctcagattatatggggggccatatcaaggacggatggcactacgcctattcgcgccttaagcaggatccggagtacttacgtgagctaaagcacagattgttggaaaagcaagcggacggccgcggagcgctgaacgtgattttccattgtatgttatcgcagcagcgcggaccgtctgcagcgatgctgctgcttcggtcgcttgacacggcggaactttctcgctgtcgtctatgggtgttgcgtggggggttctcgcgctggcaatccgtatacggtgacgacgagagcgttacggcgggttacctacccgatctgtggcgtggaagtgcagctcctggtgcatcagctgctccaggtgctggttctggaagtggttcaggaatgctgctggacgtgaacacaaatcacacactaatgcacgatgctcatgtgcatgaacattgcctcatcaaaagcatacgtgatgatggcgcattgcactcatggagcgactcatcaaaggtattttatcccaagtcattttacgctaccgctactaataagaagaataacaagttagccagcgccagcatgaacaagaccgccacaagtaataggacggtgagcgatgagatttatttccactccactaagccgcagttcgatggtcaaggaagcgctgaacgtactagaacactaaccaagaggaatagcttcaagaggactagaatactgaaggctcgagacgattccgaactgctgaacgaaaatcgctcatctttgatgaccccgtccttaagctcggtcatgtcgcaagttaggaaaacaaattccgccaagacgttatcgggcgaatgccccatacatgagggccacttaacacagagcataaagaggaagttctccgaggaagctcaaagcgactgttcttcattgagctcctctaaacttcatcccttgacagatgatattgctgacgctgtcgatttgcagacccccgcgattggcgatgaggtactggctgagccggtcgtgcccaaaatgaaaataataaacataaatgatctcgatttgttcgacgactgggaggttaaggatttagtcgatatctttcctcccgtatacgaacggcgtccgcgatcgtcctctgccctttcactggtttctgcgtcgtccgatgccaaacttcgtccgacctctgtggacttccaaatcatcgacaagaaaggcggcaagacttcaagaaggaagagtaggagcaaatcgactacagaaaacatgatttacgaaaatgacctggtagaattagaacaatggccatctgcatcaccatcgcccgagaccgacggttcgattgcatctagcgagctcttgcccaataaaagaataagacaaaaaagtttgaataccaatttcctaaagttatactctattgaaacatcatgtaaaaggaagagtattttacccgaagtcgaagtagatgaccatctgttgaagcagctaacgtattccgaaattcggtctttggaaatcaaaaaggagccaaatgtctctacgaacgatattaagcttgccctaattactaggaaaaaattatggtctgacatggtccatgaaacaagaaatgatctttttggcgattctaccccctggaatttgcactttgttgcaacgacaagcaatacggaaccttcgcaaggccgtgaatccgcaagcgaacatgcaacggcggatttgaaaagttctttggtccgcgtacactcagacgtcaagccatggttcaacaatggcggcacaatgctcaaaccatgcggaaaactaaatttaggcaaagtcaccaataagacttccgcacctacgagagagattcaatatgtcgtaaagggctggtgtgacagcaggtttctctga

SEQ ID NO: 47 - DNA, 1704 bp, Saccharomyces cerevisiae
atgttcagcgaattaattaacttccaaaatgaaggtcatgagtgccaatgccaatgtggtagctgcaaaaataatgaacaatgccaaaaatcatgtagctgcccaacggggtgtaacagcgacgacaaatgcccctgcggtaacaagtctgaagaaaccaagaagtcatgctgctctgggaaaggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 48 - DNA, 1854 bp, Saccharomyces cerevisiae
atgcgctgggatgttatcatcttatacgcaattagccgcccatatgccacccggcgcaccgggtcgcacacacacccccgtgattcgcgatatatagcggccaatcaacggcgacctccaagcgcgtgccgggtgggcccctcgccggccaagcagcgcaaggatattcccatcttcgagctcttagatacaacgcttataaagaacgcactttttgcattaacctcttttttgtattacagaacaaacattttaacttgcccttttttaaactttctttatctctccaggacaggccaattggataaattttgcaaagatcaaacagtaacacaaattttagcaaccggaagtgcagctcctggtgcatcaggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 49 - DNA, 1689 bp, Saccharomyces cerevisiae
atgttcagcgaattaattaacttccaaaatgaaggtcatgagtgccaatgccaatgtggtagctgcaaaaataatgaacaatgccaaaaatcatgtagctgcccaacggggtgtaacagcgacgacaaatgcccctgcggtaacaagtctgaagaaaccaagaagtcatgctgctctgggaaaggaagtgcagctcctggtgcatcaggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 50 - DNA, 1980 bp, Saccharomyces cerevisiae
atggtgacagggggaatggcaagcaagtgggatcagaagggtatggacattgcctatgaggaggcggccttaggttacaaagagggtggtgttcctattggcggatgtcttatcaataacaaagacggaagtgttctcggtcgtggtcacaacatgagatttcaaaagggatccgccacactacatggtgagatctccactttggaaaactgtgggagattagagggcaaagtgtacaaagataccactttgtatacgacgctgtctccatgcgacatgtgtacaggtgccatcatcatgtatggtattccacgctgtgttgtcggtgagaacgttaatttcaaaagtaagggcgagaaatatttacaaactagaggtcacgaggttgttgttgttgacgatgagaggtgtaaaaagatcatgaaacaatttatcgatgaaagacctcaggattggtttgaagatattggtgagggaagtgcagctcctggtgcatcaggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 51 - DNA, 1695 bp, Saccharomyces cerevisiae
atgtcttcaaactatgccactcctttagacgatgaggtgtttcccttatcttttgccaattatcaatttaccgagcatgtgtcacttggtgagcattattcactcaatacttcggaagatgccaaatataataatttgaatggtcctttcgtggtaccgagagacaccgggaagttcgatttgaacacaagttctgcctcggacgagactgtgttctcgttagataaccctcaagaaaacaactacaaacaccaagccatgaataacgtccaggattgtcgcatggccgtcgcggccaaaactacccagtcgtgtgataaattgaccgatctttatgccaatgccgcccaacaaaactacagattgtggctgtcttcatttggaagtgcagctcctggtgcatcaggttctggaagtggttcaggaatgaatcagtgcgcgaaggacataactcatgaagcctccagtatacccatcgatttgcaagaaagatactcgcactggaagaaaaacactaaactactttatgattacctaaacacgaattcaacaaagtggccgtccttaacgtgccagttctttcctgatttagataccacttcggatgagcatcgcatcttgttatcctcatttacatcttcccaaaaacctgaagatgagaccatatatattagcaaaatatccacgttgggtcatataaaatggtcatctttaaataatttcgacatggacgaaatggaattcaaaccggagaactcgacaaggtttccctccaaacacttagtaaatgacatcagtattttcttcccaaacggggaatgcaatagggcaagatatttgcctcaaaatccagatattatagccggcgcctcttcagatggtgcaatctacatattcgatagaacaaaacacggctctactagaataagacagtccaaaatttcacatccctttgagacaaagctgtttggttcacatggtgttattcaagacgtggaggcaatggatacttcttcggcagatataaatgaggcgacttctttagcctggaacttgcagcaggaggcccttttactttcttctcactccaacggccaagttcaagtttgggacattaaacaatattcgcatgagaaccctataatagatttacccttagtgtcaataaacagcgacggaacagcggtgaatgatgtaacttggatgccaacacacgattccctctttgctgcttgtactgaaggaaatgcggtctccctattagatctgaggactaagaaagagaagctccagagtaaccgtgaaaaacacgatggtggagtaaactcctgtagatttaactataagaactctttaattctagcatctgcagattcaaatgggaggctaaatttatgggatattagaaacatgaacaaaagcccaatcgctaccatggagcacggtacttccgtttcaactttagaatggagtccaaatttcgatactgtattggcaacggctggccaagaagatgggttagtcaagctatgggatacctcctgcgaagaaactatatttacccatggtggtcatatgctcggtgtgaacgacatttcgtgggacgctcatgacccttggttaatgtgcagtgtggcaaatgataattcagttcacatatggaaacctgcaggaaaccttgttggacattcgtga

SEQ ID NO: 52 - DNA, 1860 bp, Saccharomyces cerevisiae
atgcagcacacgcttacccggaccgcctctctgccagaacgctcgagcagcgcccacagcgccgctactgcgttacccgcacttcgccgcccgccagacagctgcgagactctcgtcccgctactgtgtatcttttggttcgtcttcgttagtatgagcccgctcccgccggctcgtgccaacaaatcagacaacaaaggcttaatctcagcagatcgtaacaacaaggctactctactgcttacaataccccgttgtacatccaagtcgtatacaaatgatttatccccactcaaaatgacattgctatccgccggcaagcacccaaggcctttccgccaagagcaccgttgcggaagtgcagctcctggtgcatcaggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 53 - DNA, 1887 bp, Saccharomyces cerevisiae
atgtcttcaaactatgccactcctttagacgatgaggtgtttcccttatcttttgccaattatcaatttaccgagcatgtgtcacttggtgagcattattcactcaatacttcggaagatgccaaatataataatttgaatggtcctttcgtggtaccgagagacaccgggaagttcgatttgaacacaagttctgcctcggacgagactgtgttctcgttagataaccctcaagaaaacaactacaaacaccaagccatgaataacgtccaggattgtcgcatggccgtcgcggccaaaactacccagtcgtgtgataaattgaccgatctttatgccaatgccgcccaacaaaactacagattgtggctgtcttcatttggaagtgcagctcctggtgcatcaggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 54 - DNA, 1725 bp, Saccharomyces cerevisiae
atggcagagataaaacattatcaattcaatgtcgtcatgacctgctcgggatgttctggtgcagtcaataaagttttgacgaaattagaaccagacgtttccaaaatagatatatcccttgaaaagcaattagtagatgtatatactacacttccttacgattttattttagaaaagattaagaaaaccggaaaggaagttagatctggcaaacaattgggaagtgcagctcctggtgcatcaggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 55 - DNA, 2763 bp, Saccharomyces cerevisiae
atgtctgaagctcaagaaactcacgtagagcaactaccagaatctgttgtcgatgccccagtcgaagaacagcaccaagaaccaccacaggctccagatgctccacaagaaccacaagttccacaggaatctgctccacaggaatctgctccacaagaaccaccagctccacaagaacaaaatgacgttcctccaccatctaatgctccaatttatgaaggcgaagaatcccacagtgtccaagactaccaagaggcccaccagcaccaccaaccacctgaaccccaaccatattatcctcctcctcctccaggtgaacacatgcacggtcgcccaccaatgcaccaccgtcaagaaggagaactctcgaacaccagattgtttgttagacctttcccattggacgttcaagaatccgagttgaatgaaatctttggtccatttggaccaatgaaggaagtcaagatcttgaacggcttcgcgtttgttgaatttgaagaagcagaatccgctgccaaagccattgaagaagttcacggtaagagttttgctaaccaacctttggaagttgtttactctaaattgcctgccaagagataccgtatcaccatgaaaaacttaccagaaggttgttcatggcaagatcttaaagatttagccagggaaaatagtttagaaactactttttctagcgtcaataccagagattttgatggtaccggtgctctagaattccctagtgaagaaatcttggtcgaagctttggagagattaaacaatattgaattcagaggttctgtcattactgttgaaagagatgacaatcctccaccaatcagaagatcaaatagaggtggcttcagaggtcgcggcggcttcagaggcggcttcagaggtggcttcagaggcggtttctccagaggcggcttcggtggccccagaggtggatttggtggtccaagaggtggttacggtggctattccagaggtggctacggtggctactccagaggcggatatggtggctccagaggtggttacgatagtcctagaggtggttacgatagtccaagaggtggttattccagaggtggctatggtggtccaagaaatgattacggtcctccaagaggtagctacggtggttcaagaggtggttatgatggtccaagaggcgattatggtcctccaagagatgcatacagaaccagagatgctccacgtgaaagatcaccaaccaggggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 56 - DNA, 2170 bp, Saccharomyces cerevisiae
atggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagggaagtgcagctcctggtgcatcagctgctccaggtgctggttctggaagtggttcaggaatggtagtatccatcataccgcaatttcctgatatcaaggtttcactagcattgtttgaacaggttaaaaatgctaaagaaatacgctctaaaatgagtgaattgtcgacatcctttgcctttattgacccccggttagtctgttcgggggagcagatgtattctgcaatttacaagaccttaatagaagtgaaatataacaagatgagaacaagaaatttgaattccgagtgcgtactatgtctttcacccacttccaatattagtgatgctttcctcaaattcggaatcaaagacgattcgtcacagttaatatgccttaagttccatactaatactgacgatgtagacaaagagcaattgaggacgattatgacttctatagtaaaaggacaagagatcgagtttaatgatgacaatttatcgagattttatgacgaagcgctcataagaaaagtatgttttaataataaattcgaggtaaaaacttcaacagcctcaccagaaacacattgtactaacttcacctttgttttccttttattttgtttttacctattagatctataaattaagtgatgatttcaagccccaagacgtaaatggtctctcaagagctttggtagacgctattcaattgaggggtgtgtag

SEQ ID NO: 57 - DNA, 960 bp, Saccharomyces cerevisiae
atgcgccgcctatatcgtcatcttgcttcctttttcttactcccttcctgccctggaaacaccatacaatccatcacatcatatcctgccaatgcactattacgcagctttcggcacgtgagtacggaaacaccagttcggaaccgggtacacaatagggatagtcaaagctgtccattttttccgctgatggatgacggaagtgcagctcctggtgcatcagctgctccaggtgctggttctggaagtggttcaggaatgttcgcgaaaacagcagctgctaatttaaccaagaagggtggtttgtcattgctctccaccacagcaaggagaaccaaagtcaccttgccagacttgaagtgggacttcggtgcattggaaccttatatctccggtcaaatcaacgaattgcattacaccaagcaccatcaaacttatgtgaacggattcaacactgctgttgaccaattccaagaactctcagatcttctggccaaggagccctctcccgcaaacgcaagaaaaatgattgctatccaacaaaacatcaagttccatggcggtggtttcacaaaccactgtctattctgggaaaacctggctccagagtcgcagggcggtggtgaaccacccaccggcgctttggcaaaggcaatcgacgagcagtttggcagtctggacgagctgattaagttgaccaacacaaagctagcaggcgtgcagggctccggatgggccttcattgtgaaaaacctctctaatggaggcaagctggacgttgttcaaacctacaaccaggataccgtcacaggcccactagttcctctagttgccattgacgcctgggaacacgcctactacttgcagtaccaaaacaagaaagccgactacttcaaagccatttggaatgtggtcaactggaaagaagcatccagaagattcgatgctggcaagatctga

SEQ ID NO: 58 - DNA, 981 bp, Saccharomyces cerevisiae
atggccagcatagacgcattttcggaccttgagcgccggatggacgggttccaaaaggacgtggcccaggtactggcacgtcagcaaaaccacgcgcgccaacagctgcaacagttccaagcggaaatgcgtcaattacataaccaacaccaacatctcatagatgaactgcaacggcttgccacccagcgcaccgctctgcagcaacaaatacatgcggcccaacaagctacaaataccaccagagagcagtggagaagctatcacgagcgtgaatctgagttatctagacggcagtcgaccttagcagcccaatcgcgcgagctggactcgctgctgcaacagcgtggtaaagagtgtgtccaattacgcgcacgttgggctgcgcagtcgggtaacgatgccgcagaggtcgcactgtacgaacggctgttgcagcttcgtgtactacccggagccagcgatgtgcatgacgtacgtttcgtattcggcgatgattcacgctgctggatcgaagtcgcgatgcacggagaccacgtgatcggaaactctcacccggcgctggaccccaagagtcgggcaacacttgagcacgtgcttaccgtccagggcgacctcgcggcatttttagtcgtggcccgcgatatgcttctggcatctttaggaagtgcagctcctggtgcatcagctgctccaggtgctggttctggaagtggttcaggaatgattctcgctttgggcgacttcctgcctaaacaggaagacaaagcatgcgagaggccctgggttcaattcccagctcgccccgttatcttttttcaccatcagggcggaatttttttgtttagcatcaatcaacctaacctctcatgcttctccaagctgaaagaagtaaactcactctatgtacgtgttgcaacatatatctgccaaaagaatgaaagtaggttcagaacaaacagattgaaaggagaccagtaa

SEQ ID NO: 59 - DNA, 1206 bp, Saccharomyces cerevisiae
atgcgccgcctatatcgtcatcttgcttcctttttcttactcccttcctgccctggaaacaccatacaatccatcacatcatatcctgccaatgcactattacgcagctttcggcacgtgagtacggaaacaccagttcggaaccgggtacacaatagggatagtcaaagctgtccattttttccgctgatggatgacggaagtgcagctcctggtgcatcagctgctccaggtgctggttctggaagtggttcaggaatgggaaggacatttattcatgcttcgaaaataaaacatgcggcacgcaaaagaaaacatcattccaactttagaactctgatcaaattattgaacaatgatgcctataagatagaatcatcaaaaccgttgaaaaatggtaaacttttcaaatactggaaaaataggcgtagattgttttcaaagatagattcggcgtcgatatatatgactgatgagctgtggttcagtgtgacgcccgaaagaattgcctgcttcctggcaaattttgttaaggcatgcatgccaaatgccgaaagaatactggatgttttctgtggtgggggcgggaacaccatacaatttgccatgcaatttccttacgtctatggagtggactacagtattgaacacatatattgtactgcgaaaaacgcccaaagctacggtgtggacgacagaatatggctgaagcggggatcctggaaaaagctagtctctaagcagaaactttccaaaataaagtacgactgtgtatttggatcacccccgtggggtggtccagaatacttaagaaacgatgtgtatgacttagagcaacatctaaagcctatggggattaccaagatgttgaaaagttttcttaaactaagccctaatgtgattatgtttttgccaaggaactctgatttgaaccagctttctcgagctacgaggaaagtactaggtccatttgccaaatgtaaagtattatatgtaaaggagaatggatatatgaaaggaatattttgcatgtggggggaatgcttttttaactacgaaccagcaagtacggagaatagtcgaagggagtcgtccgaaaaggaagagctgagttctgaaaacgaagagctctcgaaaagaaaaaagcatgaatccacaacaacgaccaaagataatactgtagacatttacgacgtaaatggttaa

SEQ ID NO: 60 - DNA, 2220 bp, Saccharomyces cerevisiae
atgggagtgaagcaaaccccaccagtccaggtgaaagtaagcgacgcggattccaccaacagaaggaaatctagtagccaggaaggaaaccctcagctggttcaattaaaggcaaagagcgacaaagataaaagaaagggatcttcagattccactgcctctataatgggcagttccaacgcacttccgaccaaaaacctaaccacgcctccagcactaaaccccttaacgaccagcattagtaggggtaatactgcatacgaaagaagcgtaaatggtagccgtataacaatgcactcaaacctggcacctacggagacgcaagacgtatcatggtctgaaatcgatacactggatgatgtgaagaagatggcgaaagaacctatcgtcaacgacgggttcccacgagattttgagagcaatctcacgcaaatgcgcaagtcgcacgctcaactactgcgattaatgagggaaagaaatcagcgactaaagtatgccaagctgaggagccctcctcataaggatcagcataattctgccacgaataaagatcaagaaccagacgaggtattgcatgacccggaaatcgcacttgacggtgagaagtacgtgagccaagttgtcgatactattaaagatgttcaccgatgcggaagtgcagctcctggtgcatcagctgctccaggtgctggttctggaagtggttcaggaatgctgctggacgtgaacacaaatcacacactaatgcacgatgctcatgtgcatgaacattgcctcatcaaaagcatacgtgatgatggcgcattgcactcatggagcgactcatcaaaggtattttatcccaagtcattttacgctaccgctactaataagaagaataacaagttagccagcgccagcatgaacaagaccgccacaagtaataggacggtgagcgatgagatttatttccactccactaagccgcagttcgatggtcaaggaagcgctgaacgtactagaacactaaccaagaggaatagcttcaagaggactagaatactgaaggctcgagacgattccgaactgctgaacgaaaatcgctcatctttgatgaccccgtccttaagctcggtcatgtcgcaagttaggaaaacaaattccgccaagacgttatcgggcgaatgccccatacatgagggccacttaacacagagcataaagaggaagttctccgaggaagctcaaagcgactgttcttcattgagctcctctaaacttcatcccttgacagatgatattgctgacgctgtcgatttgcagacccccgcgattggcgatgaggtactggctgagccggtcgtgcccaaaatgaaaataataaacataaatgatctcgatttgttcgacgactgggaggttaaggatttagtcgatatctttcctcccgtatacgaacggcgtccgcgatcgtcctctgccctttcactggtttctgcgtcgtccgatgccaaacttcgtccgacctctgtggacttccaaatcatcgacaagaaaggcggcaagacttcaagaaggaagagtaggagcaaatcgactacagaaaacatgatttacgaaaatgacctggtagaattagaacaatggccatctgcatcaccatcgcccgagaccgacggttcgattgcatctagcgagctcttgcccaataaaagaataagacaaaaaagtttgaataccaatttcctaaagttatactctattgaaacatcatgtaaaaggaagagtattttacccgaagtcgaagtagatgaccatctgttgaagcagctaacgtattccgaaattcggtctttggaaatcaaaaaggagccaaatgtctctacgaacgatattaagcttgccctaattactaggaaaaaattatggtctgacatggtccatgaaacaagaaatgatctttttggcgattctaccccctggaatttgcactttgttgcaacgacaagcaatacggaaccttcgcaaggccgtgaatccgcaagcgaacatgcaacggcggatttgaaaagttctttggtccgcgtacactcagacgtcaagccatggttcaacaatggcggcacaatgctcaaaccatgcggaaaactaaatttaggcaaagtcaccaataagacttccgcacctacgagagagattcaatatgtcgtaaagggctggtgtgacagcaggtttctctga

SEQ ID NO: 61 - DNA, 1827 bp, Saccharomyces cerevisiae
atgtccggaaaagcttctacagagggtagcgttactacggagtttctctctgatatcattggtaagacagtgaacgtcaaacttgcctcgggtttactctacagcggaagattggaatccattgatggttttatgaatgttgcactatcgagtgccactgaacactacgagagtaataacaataagcttctaaataagttcaatagtgatgtctttttgaggggcacgcaggtcatgtatatcagtgaacaaaaaataggaagtgcagctcctggtgcatcagctgctccaggtgctggttctggaagtggttcaggaatgctgctggacgtgaacacaaatcacacactaatgcacgatgctcatgtgcatgaacattgcctcatcaaaagcatacgtgatgatggcgcattgcactcatggagcgactcatcaaaggtattttatcccaagtcattttacgctaccgctactaataagaagaataacaagttagccagcgccagcatgaacaagaccgccacaagtaataggacggtgagcgatgagatttatttccactccactaagccgcagttcgatggtcaaggaagcgctgaacgtactagaacactaaccaagaggaatagcttcaagaggactagaatactgaaggctcgagacgattccgaactgctgaacgaaaatcgctcatctttgatgaccccgtccttaagctcggtcatgtcgcaagttaggaaaacaaattccgccaagacgttatcgggcgaatgccccatacatgagggccacttaacacagagcataaagaggaagttctccgaggaagctcaaagcgactgttcttcattgagctcctctaaacttcatcccttgacagatgatattgctgacgctgtcgatttgcagacccccgcgattggcgatgaggtactggctgagccggtcgtgcccaaaatgaaaataataaacataaatgatctcgatttgttcgacgactgggaggttaaggatttagtcgatatctttcctcccgtatacgaacggcgtccgcgatcgtcctctgccctttcactggtttctgcgtcgtccgatgccaaacttcgtccgacctctgtggacttccaaatcatcgacaagaaaggcggcaagacttcaagaaggaagagtaggagcaaatcgactacagaaaacatgatttacgaaaatgacctggtagaattagaacaatggccatctgcatcaccatcgcccgagaccgacggttcgattgcatctagcgagctcttgcccaataaaagaataagacaaaaaagtttgaataccaatttcctaaagttatactctattgaaacatcatgtaaaaggaagagtattttacccgaagtcgaagtagatgaccatctgttgaagcagctaacgtattccgaaattcggtctttggaaatcaaaaaggagccaaatgtctctacgaacgatattaagcttgccctaattactaggaaaaaattatggtctgacatggtccatgaaacaagaaatgatctttttggcgattctaccccctggaatttgcactttgttgcaacgacaagcaatacggaaccttcgcaaggccgtgaatccgcaagcgaacatgcaacggcggatttgaaaagttctttggtccgcgtacactcagacgtcaagccatggttcaacaatggcggcacaatgctcaaaccatgcggaaaactaaatttaggcaaagtcaccaataagacttccgcacctacgagagagattcaatatgtcgtaaagggctggtgtgacagcaggtttctctga

SEQ ID NO: 62 - DNA, 1827 bp, Saccharomyces cerevisiae
atgtctagtgaaagagcctgtatgctgtgtggcatagtgcagaccacaaatgagtttaatagagatggttgtcccaactgtcagggtatttttgaagaggcaggtgtttctacaatggaatgtacgtcgccttctttcgagggcctcgtaggaatgtgtaagcctactaagtcgtgggtagcaaagtggctgagcgtagatcatagtatagctggtatgtacgccatcaaggtcgatggtagactaccagctgaggttgtggagctgttgcctcactacaaaccgagggatggcagtcaagttgagggaagtgcagctcctggtgcatcagctgctccaggtgctggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 63 - DNA, 3000 bp, Saccharomyces cerevisiae
atgtctgaaattactttgggtaaatatttgttcgaaagattaaagcaagtcaacgttaacaccgttttcggtttgccaggtgacttcaacttgtccttgttggacaagatctacgaagttgaaggtatgagatgggctggtaacgccaacgaattgaacgctgcttacgccgctgatggttacgctcgtatcaagggtatgtcttgtatcatcaccaccttcggtgtcggtgaattgtctgctttgaacggtattgccggttcttacgctgaacacgtcggtgttttgcacgttgttggtgtcccatccatctctgctcaagctaagcaattgttgttgcaccacaccttgggtaacggtgacttcactgttttccacagaatgtctgccaacatttctgaaaccactgctatgatcactgacattgctaccgccccagctgaaattgacagatgtatcagaaccacttacgtcacccaaagaccagtctacttaggtttgccagctaacttggtcgacttgaacgtcccagctaagttgttgcaaactccaattgacatgtctttgaagccaaacgatgctgaatccgaaaaggaagtcattgacaccatcttggctttggtcaaggatgctaagaacccagttatcttggctgatgcttgttgttccagacacgacgtcaaggctgaaactaagaagttgattgacttgactcaattcccagctttcgtcaccccaatgggtaagggttccattgacgaacaacacccaagatacggtggtgtttacgtcggtaccttgtccaagccagaagttaaggaagccgttgaatctgctgacttgattttgtctgtcggtgctttgttgtctgatttcaacaccggttctttctcttactcttacaagaccaagaacattgtcgaattccactccgaccacatgaagatcagaaacgccactttcccaggtgtccaaatgaaattcgttttgcaaaagttgttgaccactattgctgacgccgctaagggttacaagccagttgctgtcccagctagaactccagctaacgctgctgtcccagcttctaccccattgaagcaagaatggatgtggaaccaattgggtaacttcttgcaagaaggtgatgttgtcattgctgaaaccggtacctccgctttcggtatcaaccaaaccactttcccaaacaacacctacggtatctctcaagtcttatggggttccattggtttcaccactggtgctaccttgggtgctgctttcgctgctgaagaaattgatccaaagaagagagttatcttattcattggtgacggttctttgcaattgactgttcaagaaatctccaccatgatcagatggggcttgaagccatacttgttcgtcttgaacaacgatggttacaccattgaaaagttgattcacggtccaaaggctcaatacaacgaaattcaaggttgggaccacctatccttgttgccaactttcggtgctaaggactatgaaacccacagagtcgctaccaccggtgaatgggacaagttgacccaagacaagtctttcaacgacaactctaagatcagaatgattgaaatcatgttgccagtcttcgatgctccacaaaacttggttgaacaagctaagttgactgctgctaccaacgctaagcaaggaagtgcagctcctggtgcatcagctgctccaggtgctggttctggaagtggttcaggaatggtatcttctttgcccaaggaatcgcaagccgaattgcaactgttccagaacgaaatcaacgccgctaatccgtccgactttcttcagttctccgccaactatttcaataaaaggctggaacaacagagagcgttcctcaaggccagggagcctgaatttaaggcaaagaacattgttctatttccggaaccagaggagtcattttccagacctcaatcagctcaatctcaatcaagatccagatcgagtgttatgttcaaatccccctttgtgaacgaggacccacactccaacgtgtttaaaagtgggtttaatttagacccgcacgaacaggacactcaccagcaagcacaggaagaacaacagcatactagagaaaagacatcaactcctccactcccaatgcacttcaacgcccaaaggcgtacttctgttagtggtgagaccttacaaccaaacaattttgacgattggactccagatcactataaggaaaagtccgagcagcaattgcaaagactggaaaaatcgatccgtaataactttctgttcaacaagctggattccgactcaaaaaggctggtcataaattgtctggaggagaagtccgtccccaaaggtgctacgataatcaagcaaggtgaccaaggggactacttctatgtcgtcgaaaagggtactgttgacttctacgtcaacgacaacaaggtcaactcttccgggccaggctccagtttcggggaacttgctcttatgtacaacagccctcgtgctgccaccgttgtagcaacctccgactgtttgttgtgggctctagacaggctcaccttcagaaaaatacttttgggcagctctttcaagaagagactcatgtatgacgatcttttgaagagcatgccagttttgaagagtttgactacgtacgaccgtgccaaacttgccgatgcactggataccaagatctaccagccgggtgaaacaatcattcgcgagggtgatcaaggggagaacttttatttaattgagtacggagctgtggacgtctctaagaagggccaaggtgtcataaataaactgaaagaccatgattatttcggtgaagtggccttgctaaacgatttgcccagacaggccactgtgactgctacaaagagaaccaaagttgccacattggggaaaagtggttttcaacgtttactgggtcctgcagtagacgtattaaagctcaatgatcctacaagacattaa

SEQ ID NO: 64 - protein, 572 aa, Saccharomyces cerevisiae
MRRLYRHLASFFLLPSCPGNTIQSITSYPANALLRSFRHVSTETPVRNRVHNRDSQSCPFFPLMDDGSAAPGASAAPGAGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 65 - protein, 665 aa, Saccharomyces cerevisiae
MKCTLVSTLFAITNILVAHAQVSNSSDTLDVQFANSTNSYIEGKFNSTDEAFNSSASWSLAAQQKKISNAAVYDVGGWNGSLYRSNRSAVADHQPGKKQDAAISQISDGQIQATASGPETTAATTPSSTANVSVYEGAGMKVESKNMGYIVGVAALLFLGSAAPGASAAPGAGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 66 - protein, 648 aa, Saccharomyces cerevisiae
MTEVVGFWESVSDDESEDKDCMEVQNTVSADESPLVQSLVSFVGSCSINLLLPFLNGMMLGFGELFAHELCWRFNWFNHRNKGYKVYPESRKIAALKEISSPGTRGRVASKFLGSAAPGASAAPGAGSGSGSGMFQRKTLQRRNLKGLNLNLHPDVGNNGQLQEKTETHQGQSRIEGHVMSNINAIQNNSNLFLRRGIKKKLTLDAFGDDQAISKPNTVVIQQPQNEPVLVLSSLSQSPCVSSSSSLSTPCIIDAYSNNFGLSPSSTNSTPSTIQGLSNIATPVENEHSISLPPLEESLSPAAADLKDTLSGTSNGNYIQLQDLVQLGKIGAGNSGTVVKALHVPDSKIVAKKTIPVEQNNSTIINQLVRELSIVKNVKPHENIITFYGAYYNQHINNEIIILMEYSDCGSLDKILSVYKRFVQRGTVSSKKTWFNELTISKIAYGVLNGLDHLYRQYKIIHRDIKPSNVLINSKGQIKLCDFGVSKKLINSIADTFVGTSTYMSPERIQGNVYSIKGDVWSLGLMIIELVTGEFPLGGHNDTPDGILDLLQRIVNEPSPRLPKDRIYSKEMTDFVNRCCIKNERERSSIHELLHHDLIMKYVSPSKDDKFRHWCRKIKSKIKEDKRIKREALDRAKLEKKQSERSTH

SEQ ID NO: 67 - protein, 1039 aa, Saccharomyces cerevisiae
MERLKQLEEKRRQLKELRERRKQASLFPGSETMGHHPTEVHAKATMVSVSVQTDMEEGSKIQEPQSAYLRRKEVITYDKGIQTDQIEEEQLQENENHTTTDAVAIETTAADENNKDKAENDQPRLELAKPFLVEEAAATLSNASFARLETEVSASGQQAPSNMQQDKDNLMQWNMVSENLQSETDCDCIAQEYDPGKGVLVVVYLRLPPADLQYASSEAAWSVVNVVKCDNASGRNGLLIDMVEFRGTRIMTATILRRYHPESNVISILLATLTGKIILYELRLKQKKPETPVVYVVQRNMVARHYFQHPVVAVIETSSVQDQERVLVAADNGNIMELSCLDLTVLRKPQQLRPVPLSQLLSLENDTCTYTERLQRLAKFDEVGIACMAYTSEDPQYVWIGGEDGGIYKVFWDQPGPLYLSLDNNGFQPAENHSTRVTGLEFHWDDARRLMLLLSCSTDWTVRLWDARAGKAIIGAPLLLGGPVLRARWLEKNNGGENSRTLRCQVWCADGRLVVVNWAFDAKTSLYTATVISGSAAPGASAAPGAGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 68 - protein, 799 aa, Saccharomyces cerevisiae
MDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQGSAAPGASAAPGAGSGSGSGMASVNNYQVDCGSRSARIQPRINNGIHDEESLFEVLELSEEEFELDFHRLKSFNDVRVINNPDLSPECTNTAISRDETLESASSAFEVPSDEIAILSISSDSNKNSPPSEQPAPALRNIRSSSNSDRIDEWCLGSHLFNELHQNVPQSSDGVNHGFPVYSFKERELYTSAKLKKLTNAQRIAVQKLSRDLYPILRTCYREKTRRQLLTYHHERIFDDIPSFFPQRDFIFNYYSMPLEFDRLSDVDIDSSSRSRFTDESTGETLNRSPSAASSSLENTSWFGWTLLSRFLDREW

SEQ ID NO: 69 - protein, 713 aa, Saccharomyces cerevisiae
MSNANNSAMNHITLPPISSFDNLIKAAERQYNGEASSASTHPTLPNMNISNGSGSAGASSSMLSYQLLPHSNDVSRSNSSSSFLPSVQQPTEGSASASETSSSASPSRSISPILKVAGPSSVGGAGVSTPHSTKINKPRKKKQCPICRNFYANLTTHKATHLTPEDRPHKCPICHRGFARNNDLLRHKKRHWKDEILSQSGVLSNHNDGKGGSVSPNDDDTHEKMTPMNSVTDYAQLKSLHQIKGTFKCPFNSTLIQLDMDMYPYKLKPLNFETSNCHQTGVFSRCDTFKNHLKALHFEYPPGTKKKDRNVVPGRCKHCGLKFENVDVWLNEHVGKQCGYKYHGSAAPGASAAPGAGSGSGSGMNWLFLVSLVFFCGVSTHPALAMSSNRLLKLANKSPKKIIPLKDSSFENILAPPHENAYIVALFTATAPEIGCSLCLELESEYDTIVASWFDDHPDAKSSNSDTSIFFTKVNLEDPSKTIPKAFQFFQLNNVPRLFIFKPNSPSILDHSVISISTDTGSERMKQIIQAIKQFSQVNDFSLHLPMDWTPIITSTIITFITVLLFKKQSKLMFSIISSRIIWATLSTFFIICMISAYMFNQIRNTQLAGVGPKGEVMYFLPNEFQHQFAIETQVMVLIYGTLAALVVVLVKGIQFLRSHLYPETKKAYFIDAILASFCALFIYVFFAALTTVFTIKSPAYPFPLLRLSAPFK

SEQ ID NO: 70 - protein, 898 aa, Saccharomyces cerevisiae
MDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQGSAAPGASAAPGAGSGSGSGMADTPSVAVQAPPGYGKTELFHLPLIALASKGDVKYVSFLFVPYTVLLANCMIRLGRRGCLNVAPVRNFIEEGYDGVTDLYVGIYDDLASTNFTDRIAAWENIVECTFRTNNVKLGYLIVDEFHNFETEVYRQSQFGGITNLDFDAFEKAIFLSGTAPEAVADAALQRIGLTGLAKKSMDINELKRSEDLSRGLSSYPTRMFNLIKEKSEVPLGHVHKIWKKVESQPEEALKLLLALFEIEPESKAIVVASTTNEVEELACSWRKYFRVVWIHGKLGAAEKVSRTKEFVTDGSMQVLIGTKLVTEGIDIKQLMMVIMLDNRLNIIELIQGVGRLRDGGLCYLLSRKNSWAARNRKGELPPIKEGCITEQVREFYGLESKKGKKGQHVGCCVC

SEQ ID NO: 71 - protein, 1111 aa, Saccharomyces cerevisiae
MQTSMVSAKVSIWLVCSVICSSLVRATQSVCSSQNTATTDGVRNQFQSNGWCSNNCAGHQFAIVQGFMCWCSDSEPSTQTSVGDCSGTCPGYGYEDCGNADKDLFGYIYLGQTPLSSVQSVETSTESSVYVSSSSITSSSSTSIVDTTTISPTLTSTSTTPLTTASTSTTPSTDITSALPTTTSTKLSTSIPTSTTSSTSTTTSTSSSTSTTVSVTSSTSTTTSTTSSTLISTSTSSSSSSTPTTTSSAPISTSTTSSTSTSTSTTSPTSSSAPTSSSNTTPTSTTFTTTSPSTAPSSTTVTYTSTTASPITSTITSVNLQTSLKYSVITVTSVHTMDTNISEITSRYLTMKKVITQIYSSTLGATPTSAVATTSASVGGRITNNNNSNTTNSNTPTNKSTEKKGYWDSPGKIAATFVVVGVVCLVIICILIYLIHHYRTRPARKAQDFENEYQSKFYQSKYPNEVTTTTLHTPSPSSNSTFSTPRLIYTDEKGQIMSESPSPRQSTYSLTAGSPPNDPSTLASPFHDPILPRRTSTFLHSPIQKQHEKMESNVTLGEDTVLVDQRLDPSKMLNTLANDDATNHSTISLSDNVDYSRRVLRLMNEGSAAPGASAAPGAGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 72 - protein, 785 aa, Saccharomyces cerevisiae
MGDELHNRLLHQNDGTKDAILYKIIESLVCSICHDYMFVPMMTPCGHNYCYGCLNTWFASNTQKELACPQCRSDITTIPALNTTLQQYLSFILEKLRDQNDESFKKLLTTKTKEENDYKNDKEKDTLFDKVFKNSALAVADDSDDGITRCSNCHWELDPDEVEDGNVCPHCNARIRNYAGGRDEFDEEEYSEGELDEIRESMRRRRENRFASTNPFANRDDVSSEDDDSSEEEPMREHIPLGRWARSHNRSIAVDAVDDEDDEGSAAPGASAAPGAGSGSGSGMLLDVNTNHTLMHDAHVHEHCLIKSIRDDGALHSWSDSSKVFYPKSFYATATNKKNNKLASASMNKTATSNRTVSDEIYFHSTKPQFDGQGSAERTRTLTKRNSFKRTRILKARDDSELLNENRSSLMTPSLSSVMSQVRKTNSAKTLSGECPIHEGHLTQSIKRKFSEEAQSDCSSLSSSKLHPLTDDIADAVDLQTPAIGDEVLAEPVVPKMKIININDLDLFDDWEVKDLVDIFPPVYERRPRSSSALSLVSASSDAKLRPTSVDFQIIDKKGGKTSRRKSRSKSTTENMIYENDLVELEQWPSASPSPETDGSIASSELLPNKRIRQKSLNTNFLKLYSIETSCKRKSILPEVEVDDHLLKQLTYSEIRSLEIKKEPNVSTNDIKLALITRKKLWSDMVHETRNDLFGDSTPWNLHFVATTSNTEPSQGRESASEHATADLKSSLVRVHSDVKPWFNNGGTMLKPCGKLNLGKVTNKTSAPTREIQYVVKGWCDSRFL

SEQ ID NO: 73 - protein, 898 aa, Saccharomyces cerevisiae
MADTPSVAVQAPPGYGKTELFHLPLIALASKGDVKYVSFLFVPYTVLLANCMIRLGRRGCLNVAPVRNFIEEGYDGVTDLYVGIYDDLASTNFTDRIAAWENIVECTFRTNNVKLGYLIVDEFHNFETEVYRQSQFGGITNLDFDAFEKAIFLSGTAPEAVADAALQRIGLTGLAKKSMDINELKRSEDLSRGLSSYPTRMFNLIKEKSEVPLGHVHKIWKKVESQPEEALKLLLALFEIEPESKAIVVASTTNEVEELACSWRKYFRVVWIHGKLGAAEKVSRTKEFVTDGSMQVLIGTKLVTEGIDIKQLMMVIMLDNRLNIIELIQGVGRLRDGGLCYLLSRKNSWAARNRKGELPPIKEGCITEQVREFYGLESKKGKKGQHVGCCVCGSAAPGASAAPGAGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 74 - protein, 815 aa, Saccharomyces cerevisiae
MSAVFNNATLSGLVQASTYSQTLQNVAHYQPQLNFMEKYWAAWYSYMNNDVLATGLMFFLLHEFMYFFRCLPWFIIDQIPYFRRWKLQPTKIPSAKEQLYCLKSVLLSHFLVEAIPIWTFHPMCEKLGITVEVPFPSLKTMALEIGLFFVLEDTWHYWAHRLFHYGVFYKYIHKQHHRYAAPFGLSAEYAHPAETLSLGFGTVGMPILYVMYTGKLHLFTLCVWITLRLFQAVDSHSGYDFPWSLNKIMPFWAGAEHHDLHHHYFIGNYASSFRWWDYCLDTESGPEAKASREERMKKRAENNAQKKTNGSAAPGASAAPGAGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 75 - protein, 673 aa, Saccharomyces cerevisiae
MNNETSGKETASAPLCSPKLPVEKVQRIAKNDPEYMDTSDDAFVATAFATEFFVQVLTHESLHRQQQQQQQQVPPLPDELTLSYDDISAAIVHSSDGHLQFLNDVIPTTKNLRLLVEENRVRYTTSVMPPNEVYSAYVVNDTAPKPNIVEIDLDNDEDDDEDVTDQEGSAAPGASAAPGAGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 76 - protein, 738 aa, Saccharomyces cerevisiae
MLLDVNTNHTLMHDAHVHEHCLIKSIRDDGALHSWSDSSKVFYPKSFYATATNKKNNKLASASMNKTATSNRTVSDEIYFHSTKPQFDGQGSAERTRTLTKRNSFKRTRILKARDDSELLNENRSSLMTPSLSSVMSQVRKTNSAKTLSGECPIHEGHLTQSIKRKFSEEAQSDCSSLSSSKLHPLTDDIADAVDLQTPAIGDEVLAEPVVPKMKIININDLDLFDDWEVKDLVDIFPPVYERRPRSSSALSLVSASSDAKLRPTSVDFQIIDKKGGKTSRRKSRSKSTTENMIYENDLVELEQWPSASPSPETDGSIASSELLPNKRIRQKSLNTNFLKLYSIETSCKRKSILPEVEVDDHLLKQLTYSEIRSLEIKKEPNVSTNDIKLALITRKKLWSDMVHETRNDLFGDSTPWNLHFVATTSNTEPSQGRESASEHATADLKSSLVRVHSDVKPWFNNGGTMLKPCGKLNLGKVTNKTSAPTREIQYVVKGWCDSRFLGSAAPGASAAPGAGSGSGSGMSDKVINPQVAWAQRSSTTDPERNYVLITVSIADCDAPELTIKPSYIELKAQSKPHVGDENVHHYQLHIDLYKEIIPEKTMHKVANGQHYFLKLYKKDLESEYWPRLTKEKVKYPYIKTDFDKWVDEDEQDEVEAEGNDAAQGMDFSQMMGGAGGAGGAGGMDFSQMMGGAGGAGSPDMAQLQQLLAQSGGNLDMGDFKENDEEDEEEEIEPEVKA

SEQ ID NO: 77 - protein, 748 aa, Saccharomyces cerevisiae
MATPSTGANNSIPAVRNQVEVQVGLVGDAQVGKTSLMVKYVQNIYDKEYTQTLGVNFLKRKVSIRSTDIIFSIMDLGGQREFINMLPIATVGSSVIIFLFDLTRPETLSSIKEWYRQAYGLNDSAIPILVGTKYDLLIDLDPEYQEQISRTSMKYAQVMNAPLIFCSTAKSINIQKIFKIALAKIFNLTLTIPEINEIGDPLLIYKHLGGQQHRHHNKSQDRKSHNIRKPSSSPSSKAPSPGGSAAPGASAAPGAGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 78 - protein, 687 aa, Saccharomyces cerevisiae
MVVSIIPQFPDIKVSLALFEQVKNAKEIRSKMSELSTSFAFIDPRLVCSGEQMYSAIYKTLIEVKYNKMRTRNLNSECVLCLSPTSNISDAFLKFGIKDDSSQLICLKFHTNTDDVDKEQLRTIMTSIVKGQEIEFNDDNLSRFYDEALIRKIYKLSDDFKPQDVNGLSRALVDAIQLRGVGSAAPGASAAPGAGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 79 - protein, 544 aa, Saccharomyces cerevisiae
MSLRPCLTPSSMQYSDIYIPTHSLTSTSTLAVIPYPAFGSAAPGASAAPGAGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 80 - protein, 1153 aa, Saccharomyces cerevisiae
MEAGRSADEVLYHNQSSVKLGELERYVITYELYQGDSIPADITLDSLWVKIKNTTKLSYKPAYLLGPFILYCDVRAKDYESSYKIICSADKPVFQSNLQAQQKFIAELSLHHIKPRYVWIVDIVSQILFNKETKVTFEIVVGNSKASLKRKIRCNDSLPDKACNILHTGLSVHRLTTADIWKVPRPIDMSQKSHLVILTHGFQSNVSADMEYLMEEIYKAQMNNPNERLVIKGYMKNACETEKGIKFLGVGLANYIIDELYDDSVGKISFIGHSLGGLTQTFAICYIKTKYPYFFKKVEPINFISLASPLLGIATSTPNYVKMSLSMGIIGTTGQELGLKDGNYGDKPLLYLLSEESLISVLARFKRRTLYANAVNDGIVPLYSSSLLFLDYSQLLQKLGGQTTAPCDPLFQPEVSPIGELPNHSDVANDDDGINASSWNTFWKSKENNCDKKSKRLMNASVIKSMKSVLLSPCPDAKFFSDPDARVATIIHDKIYTEKNLPPPSPTLYEGTAAKEGETRKTRKEMEEIIARRWHKGMHWRKVVVLLKPDAHNNIIVRRRFSNAYGWPVVDHLVTAHFQRDDPIASPMQDKQFAEEDINMATGGVEPNKFYSWLTKIEDPSVYHGGIVSTASQLASSWISKHSSVTDGSAAPGASAAPGAGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 81 - protein, 555 aa, Saccharomyces cerevisiae
MWRRRREPWEELSFLLNSLSPRNWFIRRWGLMAGRGQHLCWLRCACDGPGSAAPGASAAPGAGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 82 - protein, 771 aa, Saccharomyces cerevisiae
MSGTRCLLGVGLPVDVTATETLTHDEQGPGVEPGPCSRGSSIDGLLPSLLGPHDDVDDDSAAFHKYMTLSRDGAGAIHAPSLVEDASRNDDDDDDEDDDDSSMSRDLSKALDMSSSSSSSPRVQSRRHRSSVSAISAILHQGKSGREDITGSLSVPAEQEKLSFLAKASSIFFRRNSMPRDKHTHSVCPASRPDSERFIVTSAAAQSLRRQQQLEDAQYARVITNFRTIGWCSPSEIESVEYKRSLINAEWDEKISLLSHAQCYKGSAAPGASAAPGAGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 83 - protein, 727 aa, Saccharomyces cerevisiae
MASIDAFSDLERRMDGFQKDVAQVLARQQNHARQQLQQFQAEMRQLHNQHQHLIDELQRLATQRTALQQQIHAAQQATNTTREQWRSYHERESELSRRQSTLAAQSRELDSLLQQRGKECVQLRARWAAQSGNDAAEVALYERLLQLRVLPGASDVHDVRFVFGDDSRCWIEVAMHGDHVIGNSHPALDPKSRATLEHVLTVQGDLAAFLVVARDMLLASLGSAAPGASAAPGAGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 84 - protein, 1048 aa, Saccharomyces cerevisiae
MGNQSLVVLTESKGEYENETELPVKKSSRDNNIGESLTATAFTQSEDEMVDSNQKWQNPNYFKYAWQEYLFIFTCMISQLLNQAGTTQTLSIMNILSDSFGSEGNSKSWLMASFPLVSGSFILISGRLGDIYGLKKMLLVGYVLVIIWSLICGITKYSGSDTFFIISRAFQGLGIAFVLPNVLGIIGNIYVGGTFRKNIVISFVGAMAPIGATLGCLFAGLIGTEDPKQWPWAFYAYSIAAFINFVLSIYAIPSTIPTNIHHFSMDWIGSVLGVIGLILLNFVWNQAPISGWNQAYIIVILIISVIFLVVFIIYEIRFAKTPLLPRAVIKDRHMIQIMLALFFGWGSFGIFTFYYFQFQLNIRQYTALWAGGTYFMFLIWGIIAALLVGFTIKNVSPSVFLFFSMVAFNVGSIMASVTPVHETYFRTQLGTMIILSFGMDLSFPASSIIFSDNLPMEYQGMAGSLVNTVVNYSMSLCLGMGATVETQVNSDGKHLLKGYRGAQYLGIGLASLACMISGLYMVESFIKGRRARAAAEYDCTVAGSAAPGASAAPGAGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 85 - protein, 551 aa, Saccharomyces cerevisiae
MLLDVNTNHTLMHDAHVHEHCLIKSIRDDGALHSWSDSSKVFYPKSFYATATNKKNNKLASASMNKTATSNRTVSDEIYFHSTKPQFDGQGSAERTRTLTKRNSFKRTRILKARDDSELLNENRSSLMTPSLSSVMSQVRKTNSAKTLSGECPIHEGHLTQSIKRKFSEEAQSDCSSLSSSKLHPLTDDIADAVDLQTPAIGDEVLAEPVVPKMKIININDLDLFDDWEVKDLVDIFPPVYERRPRSSSALSLVSASSDAKLRPTSVDFQIIDKKGGKTSRRKSRSKSTTENMIYENDLVELEQWPSASPSPETDGSIASSELLPNKRIRQKSLNTNFLKLYSIETSCKRKSILPEVEVDDHLLKQLTYSEIRSLEIKKEPNVSTNDIKLALITRKKLWSDMVHETRNDLFGDSTPWNLHFVATTSNTEPSQGRESASEHATADLKSSLVRVHSDVKPWFNNGGTMLKPCGKLNLGKVTNKTSAPTREIQYVVKGWCDSRFLGSAAPGASAAPGAGSGSGSGMDLNQRKEKRASMLDAVAPGQTCLLTQWN

SEQ ID NO: 86 - protein, 755 aa, Saccharomyces cerevisiae
MSGKASTEGSVTTEFLSDIIGKTVNVKLASGLLYSGRLESIDGFMNVALSSATEHYESNNNKLLNKFNSDVFLRGTQVMYISEQKIGSAAPGASAAPGAGSGSGSGMSRAVGIDLGTTYSCVAHFSNDRVEIIANDQGNRTTPSYVAFTDTERLIGDAAKNQAAINPHNTVFDAKRLIGRKFDDPEVTTDAKHFPFKVISRDGKPVVQVEYKGETKTFTPEEISSMVLSKMKETAENYLGTTVNDAVVTVPAYFNDSQRQATKDAGTIAGMNVLRIINEPTAAAIAYGLDKKGRAEHNVLIFDLGGGTFDVSLLSIDEGVFEVKATAGDTHLGGEDFDNRLVNHLATEFKRKTKKDISNNQRSLRRLRTAAERAKRALSSSSQTSIEIDSLFEGMDFYTSLTRARFEELCADLFRSTLEPVEKVLKDSKLDKSQIDEIVLVGGSTRIPKIQKLVSDFFNGKEPNRSINPDEAVAYGAAVQAAILTGDQSTKTQDLLLLDVAPLSLGIETAGGIMTKLIPRNSTIPTKKSETFSTYADNQPGVLIQVFEGERTRTKDNNLLGKFELSGIPPAPRGVPQIDVTFDIDANGILNVSALEKGTGKSNKITITNDKGRLSKDDIDRMVSEAEKYRADDEREAERVQAKNQLESYAFTLKNTINEASFKEKVGEDDAKRLETASQETIDWLDASQAASTDEYKDRQKELEGIANPIMTKFYGAGAGAGPGAGESGGFPGSMPNSGATGGGEDTGPTVEEVD

SEQ ID NO: 87 - protein, 836 aa, Saccharomyces cerevisiae
MLAQTFKKPHRAVLEQVSGTTVFIRNKRTKSKSSLSPLAQRVVTQLSVMSASRKQPKLLKLAREDLIKHQTIEKCWSIYQQQQRERRNLQLELQYKSIERSMNLLQELSPRLFEAANASEKGKRFPMEMKVPTDFPPNTLWHYNFRKGSAAPGASAAPGAGSGSGSGMLRVTTLASSCTSFPLQVLRRRLTISSLTSFQPTTKTQVVVIGAGHAGCEAAAASSRTGAHTTLITPSLTDIGKCSCNPSIGGVGKGILVKEIDALDGLMGKVTDLAGVQFKMLNRSKGPAVWGPRAQIDRELYKKYMQRELSDKKAHPNLSLLQNKVADLILYDPGCGHKVIKGVVLDDGTQVGADQVIITTGTFLSAEIHIGDKRIAAGRIGEQPTYGISNTLQNEVGFQLGRLKTGTPARLAKESIDFSALEVQKGDALPVPMSFLNETVSVEPTKQLDCFGTHTTPQMHDFLRNNLHQSIHIQDTTIKGPRYCPSIEAKILRFPDRSSHKIWLEPEGFNSDVIYPNGISNSMPEDVQLQMMRLIPGMANVEILQPAYGVEYDYVDPRQLKPSLETKLVDGLFLAGQINGTTGYEEAAAQGIIAGINAGLLSRQEREQLVLKRSEAYIGVLIDDLINNGVIEPYRMFTSRSEFRISVRADNADFRLTPIGAQLGIISPVRLSQYSRDKHLYDETIRALQNFKLSSQKWSSLLQANIAPQAENRSAWEIFRFKDMDLHKLYECIPDLPINLLDIPMHVVTKINIQGKYEPYIVKQNQFVKAFQADENMLLPQDYDYRQLPTLSTECKLLLNRVQPLTIGQARRIQGITAAALFELYRVARKPSQPVM

SEQ ID NO: 88 - protein, 855 aa, Saccharomyces cerevisiae
MTLWPHPGSYKIKSATLFCSRDKLGCAFLSESSLCMYFLYNSLSIWALGPHTAGPLLLFSILNCTPARSVTLPISPSRASISFTRMPLPTPPIEGLHEHLPISVNDGVMRVVCAPVLDDAAAASQPACPAPMTTTCVLVVGWKLVKEDMVNRLLRTCKGNEVHEDAKVVTRSIVLWGVGSAAPGASAAPGAGSGSGSGMLKSGRLNFLKLNINSRLLYSTNPQLTKKVIGIDLGTTNSAVAYIRDSNDKKSATIIENDEGQRTTPSIVAFDVKSSPQNKDQMKTLVGMAAKRQNAINSENTFFATKRLIGRAFNDKEVQRDMAVMPYKIVKCESNGQAYLSTSNGLIQSPSQIASILLKYLKQTSEEYLGEKVNLAVITVPAYFNDSQRQATKDAGKLAGLNVLRVINEPTAAALSFGIDDKRNNGLIAVYDLGGGTFDISILDIEDGVFEVRATNGDTHLGGEDFDNVIVNYIIDTFIHENPEITREEITKNRETMQRLKDVSERAKIDLSHVKKTFIELPFVYKSKHLRVPMTEEELDNMTLSLINRTIPPVKQALKDADIEPEDIDEVILVGGMTRMPKIRSVVKDLFGKSPNSSVNPDETVALGAAIQGGILSGEIKNVLLLDVTPLTLGIETFGGAFSPLIPRNTTVPVKKTEIFSTGVDGQAGVDIKVFQGERGLVRNNKLIGDLKLTGITPLPKGIPQIYVTFDIDADGIINVSAAEKSSGKQQSITVIPNSGLSEEEIAKLIEEANANRAQDNLIRQRLELISKADIMISDTENLFKRYEKLISSEKEYSNIVEDIKALRQAIKNFKANENDMSIDVNGIKKATDALQGRALKLFQSATKNQQNQGK

SEQ ID NO: 89 - protein, 465 aa, Saccharomyces cerevisiae
MQIFVKTLTGKTITLEVESSDTIDNVKSKIQDKEGIPPDQQRLIFAGKQLEDGRTLSDYNIQKESTLHLVLRLRGGNGSAAPGASAAPGAGSGSGSGMPGQIISIPFLSQNEDMDKYLLEYRSLKLLHQSSNSFQSHNAPSHQSNYHPHYNHMKYNNTGSYYYYNNNNNSSVNPHNQAGLQSINRSIPSAPYGAYNQNRANDVPYMNTQKKHHRFSANNNLNQQKYKQYPQYTSNPMVTAHLKQTYPQLYYNSNVNAHNNNNNSNNNNNNNNNSNNNNNLYNQTQFSTRYFNSNSSPSLTSSTSNSSSPYNQSTFEYILPSTSAASTNLSSSSSNNSMHTNPTTATSTSADLINDLPVGPTSSSLISDLHSPPTVSFLPASQTLLMSSTTSSSIGTNINPPQHSPSPSQREDFSTAPVNMSSSASLLMNDSSLGWGSNHMNVSSSSQPASSRPFGIWNTDMSVWS

SEQ ID NO: 90 - protein, 775 aa, Saccharomyces cerevisiae
MWRRRREPWEELSFLLNSLSPRNWFIRRWGLMAGRGQHLCWLRCACDGPGSAAPGASAAPGAGSGSGSGMSFLPLRSRSRSGAPHWVYIILYHIFTIPKIYSLPLLSGSHVLNSRDVADSGHSVGDEASVTTYYIISIILVLLGGVFAGLTLGLMGQDEVYLKVISTSGSNSEKKLAKRVLDLISRGKHWVLVTLLLSNVITNETLPIVLDRCLGGGWQAVVSSTILIVIFGEIIPQSVCVKYGLQVGAFFCPFVLVLMYLMYPVAYPIATLLDYMLGEDHGTMYKKSGLKTLVTLHRTMGVERLTKDEVTIISAVLDLKAKRVEEIMTPIENVFTMSADTILDDKTVEKIFNSGFSRIPIFLPNEPNNFIGMLLVRVLISYDPDDCLPISHFPLATLPETSPNTSCLNILNYFQEGKAHMCVVSKEPGSSHGAIGVLTLEDVIEELIGEEIVDESDVFVDMHQHIMRQQPGPLSKRHITSYLHHLYTSSHKEHKAADQADESSPLLSPSNSNHPSEHPQQDLNNKSWKQKSNDGYDRSNAVLSPTPQVTEHGTIIPSNLASNPLNVNKSFVTIKKPANVPKIITTHTPHSSKEPSPAPHSNDKSLSAEEQQLLSDHAELSRQAVLHTQRSGQPTQVTTSTKTTRNSPDSISIPNSGANHGNENQNVTISTSYQNTKNGIVESVITVKGVPKTIIGPAKDWDESKSEYGNENINQENSNRSDDRESSSSNASLFSSIKNKFKNENANNNDRSNFTDSLSRTSNYDANGSSSTIKR

SEQ ID NO: 91 - protein, 767 aa, Saccharomyces cerevisiae
MDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQGSAAPGASAAPGAGSGSGSGMARGPKKHLKRLAAPHHWLLDKLSGCYAPRPSAGPHKLRESLPLIVFLRNRLKYALNGREVKAILMQRHVKVDGKVRTDTTYPAGFMDVITLDATNENFRLVYDVKGRFAVHRITDEEASYKLGKVKKVQLGKKGVPYVVTHDGRTIRYPDPNIKVNDTVKIDLASGKITDFIKFDAGKLVYVTGGRNLGRIGTIVHKERHDGGFDLVHIKDSLDNTFVTRLNNVFVIGEQGKPYISLPKGKGIKLSIAEERDRRRAQQGL

SEQ ID NO: 92 - protein, 1008 aa, Saccharomyces cerevisiae
MDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQGSAAPGASAAPGAGSGSGSGMLLDVNTNHTLMHDAHVHEHCLIKSIRDDGALHSWSDSSKVFYPKSFYATATNKKNNKLASASMNKTATSNRTVSDEIYFHSTKPQFDGQGSAERTRTLTKRNSFKRTRILKARDDSELLNENRSSLMTPSLSSVMSQVRKTNSAKTLSGECPIHEGHLTQSIKRKFSEEAQSDCSSLSSSKLHPLTDDIADAVDLQTPAIGDEVLAEPVVPKMKIININDLDLFDDWEVKDLVDIFPPVYERRPRSSSALSLVSASSDAKLRPTSVDFQIIDKKGGKTSRRKSRSKSTTENMIYENDLVELEQWPSASPSPETDGSIASSELLPNKRIRQKSLNTNFLKLYSIETSCKRKSILPEVEVDDHLLKQLTYSEIRSLEIKKEPNVSTNDIKLALITRKKLWSDMVHETRNDLFGDSTPWNLHFVATTSNTEPSQGRESASEHATADLKSSLVRVHSDVKPWFNNGGTMLKPCGKLNLGKVTNKTSAPTREIQYVVKGWCDSRFL

SEQ ID NO: 93 - protein, 610 aa, Saccharomyces cerevisiae
MVTQLKSASEYDSALASGDKLVVVDFFATWCGPCKMIAPMIEKFAEQYSDAAFYKLDVDEVSDVAQKAEVSSMPTLIFYKGGKEVTRVVGANPAAIKQAIASNVGSAAPGASAAPGAGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 94 - protein, 654 aa, Saccharomyces cerevisiae
MDSYSITNVKYLDPTELHRWMQEGHTTTLREPFQVVDVRGSDYMGGHIKDGWHYAYSRLKQDPEYLRELKHRLLEKQADGRGALNVIFHCMLSQQRGPSAAMLLLRSLDTAELSRCRLWVLRGGFSRWQSVYGDDESVTAGYLPDLWRGSAAPGASAAPGAGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 95 - protein, 668 aa, Saccharomyces cerevisiae
MVMLHSKNVKGFLENTLKPYDLHSVDFKTSSLQSSMIITATNGGILSYATSNNDVPKNSINEINSVNNLKMMSLLIKDKWSEDENDTEEQHSNSCYPVEIDSFKTKIYTYEMEDLHTCVAQIPNSDLLLLFIAEGSFPYGLLVIKIERAMRELTDLFGYKLGGSAAPGASAAPGAGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 96 - protein, 608 aa, Saccharomyces cerevisiae
MAGDSISADGTGVHPVELSVYSVLSTDLDGLYQSINELRESQALLILMLRKVRDKLRREGQVLYDPEPFKPTMDKLADLSARVRILSQRYEELQGNARALNNGSAAPGASAAPGAGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 97 - protein, 964 aa, Saccharomyces cerevisiae
MGKEKSHINVVVIGHVDSGKSTTTGHLIYKCGGIDKRTIEKFEKEAAELGKGSFKYAWVLDKLKAERERGITIDIALWKFETPKYQVTVIDAPGHRDFIKNMITGTSQADCAILIIAGGVGEFEAGISKDGQTREHALLAFTLGVRQLIVAVNKMDSVKWDESRFQEIVKETSNFIKKVGYNPKTVPFVPISGWNGDNMIEATTNAPWYKGWEKETKAGVVKGKTLLEAIDAIEQPSRPTDKPLRLPLQDVYKIGGIGTVPVGRVETGVIKPGMVVTFAPAGVTTEVKSVEMHHEQLEQGVPGDNVGFNVKNVSVKEIRRGNVCGDAKNDPPKGCASFNATVIVLNHPGQISAGYSPVLDCHTAHIACRFDELLEKNDRRSGKKLEDHPKFLKSGDAALVKFVPSKPMCVEAFSEYPPLGRFAVRDMRQTVAVGVIKSVDKTEKAAKVTKAAQKAAKKGSAAPGASAAPGAGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 98 - protein, 594 aa, Saccharomyces cerevisiae
MTSKREKSLDHTLELKIPFETERQATIATKVLSPDPILKPQDFQVDYSSEKNVMLVQFRSIDDRVLRVGVSSIIDSIKTIVEAMDVLSGSAAPGASAAPGAGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 99 - protein, 650 aa, Saccharomyces cerevisiae
MGKKAHGGKMKPEIDENGTLLVPPPRTIANQDHFHRLNYLYQISAYQTRARQKARTDAHTPLARNYIKSMDLISKKTKTSLLPTIKRTICKKCHRLLWTPKKLEITSDGALSVMCGCGTVKRFNIGADPNYRTYSEREGNLLNSGSAAPGASAAPGAGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 100 - protein, 629 aa, Saccharomyces cerevisiae
MKLPVAQYSAPDGVEKSFAPIRDDPRYMTTEGRTTGPSDHVLNAGQIDRDKPSEPERTKDGSQLTYLGQLRTQLTGLQDDINEFLTGRMELAKNKKKAGADEKRIQEEINQLLDGGDGDEDAVGSAAPGASAAPGAGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 101 - protein, 209 aa, Saccharomyces cerevisiae
MSSVESSPISRYEDEVFPLSFSNVAFEPPMLSHSPDRSTYADDFSQSYQQELLTFPLSYPIVDESECTHTKDKTDSNIITSTEDDCMFDMEFNGNAASAVAAASKESNSASGFAFASNDAFANVAQQNYRLWLSSVGSAAPGASAAPGAGSGSGSGMVQYAPFLLGKFSDPLLAIMVGCLSYYVYERKMGRPQGHHLHELIKKRWDDRK

SEQ ID NO: 102 - protein, 709 aa, Saccharomyces cerevisiae
MSQGRKAAERLAKKTVLITGASAGIGKATALEYLEASNGDMKLILAARRLEKLEELKKTIDQEFPNAKVHVAQLDITQAEKIKPFIENLPQEFKDIDILVNNAGKALGSDRVGQIATEDIQDVFDTNVTALINITQAVLPIFQAKNSGDIVNLGSIAGRDAYPTGSIYCASKFAVGAFTDSLRKELINTKIRVILIAPGLVETEFSLVRYRGNEEQAKNVYKDTTPLMADDVADLIVYATSRKQNTVIADTLIFPTNQASPHHIFRGGSAAPGASAAPGAGSGSGSGMNQCAKDITHEASSIPIDLQERYSHWKKNTKLLYDYLNTNSTKWPSLTCQFFPDLDTTSDEHRILLSSFTSSQKPEDETIYISKISTLGHIKWSSLNNFDMDEMEFKPENSTRFPSKHLVNDISIFFPNGECNRARYLPQNPDIIAGASSDGAIYIFDRTKHGSTRIRQSKISHPFETKLFGSHGVIQDVEAMDTSSADINEATSLAWNLQQEALLLSSHSNGQVQVWDIKQYSHENPIIDLPLVSINSDGTAVNDVTWMPTHDSLFAACTEGNAVSLLDLRTKKEKLQSNREKHDGGVNSCRFNYKNSLILASADSNGRLNLWDIRNMNKSPIATMEHGTSVSTLEWSPNFDTVLATAGQEDGLVKLWDTSCEETIFTHGGHMLGVNDISWDAHDPWLMCSVANDNSVHIWKPAGNLVGHS

SEQ ID NO: 103 - protein, 663 aa, Saccharomyces cerevisiae
MSDEEHTFETADAGSSATYPMQCSALRKNGFVVIKSRPCKIVDMSTSKTGKHGHAKVHLVAIDIFTGKKLEDLSPSTHNMEVPVVKRNEYQLLDIDDGFLSLMNMDGDTKDDVKAPEGELGDSLQTAFDEGKDLMVTIISAMGEEAAISFKEAARTDGSAAPGASAAPGAGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 104 - protein, 642 aa, Saccharomyces cerevisiae
MSSVESSPISRYEDEVFPLSFSNVAFEPPMLSHSPDRSTYADDFSQSYQQELLTFPLSYPIVDESECTHTKDKTDSNIITSTEDDCMFDMEFNGNAASAVAAASKESNSASGFAFASNDAFANVAQQNYRLWLSSVGSAAPGASAAPGAGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 105 - protein, 171 aa, Saccharomyces cerevisiae
MWRRRREPWEELSFLLNSLSPRNWFIRRWGLMAGRGQHLCWLRCACDGPGSAAPGASAAPGAGSGSGSGMSSERACMLCGIVQTTNEFNRDGCPNCQGIFEEAGVSTMECTSPSFEGLVGMCKPTKSWVAKWLSVDHSIAGMYAIKVDGRLPAEVVELLPHYKPRDGSQVE

SEQ ID NO: 106 - protein, 716 aa, Saccharomyces cerevisiae
MMSQVSHSQEGSGRFWNKFKSSTKSLSTSLAHLSIKAEKDGDTVNTTLVHKGLVKFYENQHPFQGFPGWLGEKEDLPNERKILDTQVKHDMKKQNSRHFSPSFSNRRKASSEDPMGTPSSNGNTPEYTPASKSFQDIYNNHTSSSSATPRRASSRPTRPSAGQEFRASLGRSKTSNSFNTSSTPTPPPDASSGVMAMKDRLKRRNNDYGFGSAAPGASAAPGAGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 107 - protein, 744 aa, Saccharomyces cerevisiae
MSHKLTILPFLIKFTPKFPQSIDHDEHGLNVYAFDLDHTIIKPKSPNISFSRSASDWQFINFNSKKSTLDYLCNIIDNDPTAVIVIFSNQGGVITVPRTSKSCTKYTNKILLFLKAIKNDERGETLSHRLWLYAAPKRPKTFAANHSKITFASLGESYNNDPNIFEKVRKPMTGMVEFFKRDLESAYRVSEQISPIKLNWIYYCGDAAGRKKDFSDSDIKFAENLHVEFKYPEEIFHGGSAAPGASAAPGAGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 108 - protein, 751 aa, Saccharomyces cerevisiae
MNQCAKDITHEASSIPIDLQERYSHWKKNTKLLYDYLNTNSTKWPSLTCQFFPDLDTTSDEHRILLSSFTSSQKPEDETIYISKISTLGHIKWSSLNNFDMDEMEFKPENSTRFPSKHLVNDISIFFPNGECNRARYLPQNPDIIAGASSDGAIYIFDRTKHGSTRIRQSKISHPFETKLFGSHGVIQDVEAMDTSSADINEATSLAWNLQQEALLLSSHSNGQVQVWDIKQYSHENPIIDLPLVSINSDGTAVNDVTWMPTHDSLFAACTEGNAVSLLDLRTKKEKLQSNREKHDGGVNSCRFNYKNSLILASADSNGRLNLWDIRNMNKSPIATMEHGTSVSTLEWSPNFDTVLATAGQEDGLVKLWDTSCEETIFTHGGHMLGVNDISWDAHDPWLMCSVANDNSVHIWKPAGNLVGHSGSAAPGASAAPGAGSGSGSGMQGNKSTIREYKIVVVGGGGVGKSALTIQFIQSYFVDEYDPTIEDSYRKQVVIDDKVSILDILDTAGQEEYSAMREQYMRTGEGFLLVYSVTSRNSFDELLSYYQQIQRVKDSDYIPVVVVGNKLDLENERQVSYEDGLRLAKQLNAPFLETSAKQAINVDEAFYSLIRLVRDDGGKYNSMNRQLDNTNEIRDSELTSSATADREKKNNGSYVLDNSLTNAGTGSSSKSAVNHNGETTKRTDEKNYVNQNNNNEGNTKYSSNGNGNRSDISRGNQNNALNSRSKQSAEPQKNSSANARKESSGGCCIIC

SEQ ID NO: 109 - protein, 670 aa, Saccharomyces cerevisiae
MDSYSITNVKYLDPTELHRWMQEGHTTTLREPFQVVDVRGSDYMGGHIKDGWHYAYSRLKQDPEYLRELKHRLLEKQADGRGALNVIFHCMLSQQRGPSAAMLLLRSLDTAELSRCRLWVLRGGFSRWQSVYGDDESVTAGYLPDLWRGSAAPGASAAPGAGSGSGSGMLLDVNTNHTLMHDAHVHEHCLIKSIRDDGALHSWSDSSKVFYPKSFYATATNKKNNKLASASMNKTATSNRTVSDEIYFHSTKPQFDGQGSAERTRTLTKRNSFKRTRILKARDDSELLNENRSSLMTPSLSSVMSQVRKTNSAKTLSGECPIHEGHLTQSIKRKFSEEAQSDCSSLSSSKLHPLTDDIADAVDLQTPAIGDEVLAEPVVPKMKIININDLDLFDDWEVKDLVDIFPPVYERRPRSSSALSLVSASSDAKLRPTSVDFQIIDKKGGKTSRRKSRSKSTTENMIYENDLVELEQWPSASPSPETDGSIASSELLPNKRIRQKSLNTNFLKLYSIETSCKRKSILPEVEVDDHLLKQLTYSEIRSLEIKKEPNVSTNDIKLALITRKKLWSDMVHETRNDLFGDSTPWNLHFVATTSNTEPSQGRESASEHATADLKSSLVRVHSDVKPWFNNGGTMLKPCGKLNLGKVTNKTSAPTREIQYVVKGWCDSRFL

SEQ ID NO: 110 - protein, 567 aa, Saccharomyces cerevisiae
MFSELINFQNEGHECQCQCGSCKNNEQCQKSCSCPTGCNSDDKCPCGNKSEETKKSCCSGKGSAAPGASAAPGAGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 111 - protein, 617 aa, Saccharomyces cerevisiae
MRWDVIILYAISRPYATRRTGSHTHPRDSRYIAANQRRPPSACRVGPSPAKQRKDIPIFELLDTTLIKNALFALTSFLYYRTNILTCPFLNFLYLSRTGQLDKFCKDQTVTQILATGSAAPGASGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 112 - protein, 562 aa, Saccharomyces cerevisiae
MFSELINFQNEGHECQCQCGSCKNNEQCQKSCSCPTGCNSDDKCPCGNKSEETKKSCCSGKGSAAPGASGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 113 - protein, 659 aa, Saccharomyces cerevisiae
MVTGGMASKWDQKGMDIAYEEAALGYKEGGVPIGGCLINNKDGSVLGRGHNMRFQKGSATLHGEISTLENCGRLEGKVYKDTTLYTTLSPCDMCTGAIIMYGIPRCVVGENVNFKSKGEKYLQTRGHEVVVVDDERCKKIMKQFIDERPQDWFEDIGEGSAAPGASGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 114 - protein, 564 aa, Saccharomyces cerevisiae
MSSNYATPLDDEVFPLSFANYQFTEHVSLGEHYSLNTSEDAKYNNLNGPFVVPRDTGKFDLNTSSASDETVFSLDNPQENNYKHQAMNNVQDCRMAVAAKTTQSCDKLTDLYANAAQQNYRLWLSSFGSAAPGASGSGSGSGMNQCAKDITHEASSIPIDLQERYSHWKKNTKLLYDYLNTNSTKWPSLTCQFFPDLDTTSDEHRILLSSFTSSQKPEDETIYISKISTLGHIKWSSLNNFDMDEMEFKPENSTRFPSKHLVNDISIFFPNGECNRARYLPQNPDIIAGASSDGAIYIFDRTKHGSTRIRQSKISHPFETKLFGSHGVIQDVEAMDTSSADINEATSLAWNLQQEALLLSSHSNGQVQVWDIKQYSHENPIIDLPLVSINSDGTAVNDVTWMPTHDSLFAACTEGNAVSLLDLRTKKEKLQSNREKHDGGVNSCRFNYKNSLILASADSNGRLNLWDIRNMNKSPIATMEHGTSVSTLEWSPNFDTVLATAGQEDGLVKLWDTSCEETIFTHGGHMLGVNDISWDAHDPWLMCSVANDNSVHIWKPAGNLVGHS

SEQ ID NO: 115 - protein, 619 aa, Saccharomyces cerevisiae
MQHTLTRTASLPERSSSAHSAATALPALRRPPDSCETLVPLLCIFWFVFVSMSPLPPARANKSDNKGLISADRNNKATLLLTIPRCTSKSYTNDLSPLKMTLLSAGKHPRPFRQEHRCGSAAPGASGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 116 - protein, 628 aa, Saccharomyces cerevisiae
MSSNYATPLDDEVFPLSFANYQFTEHVSLGEHYSLNTSEDAKYNNLNGPFVVPRDTGKFDLNTSSASDETVFSLDNPQENNYKHQAMNNVQDCRMAVAAKTTQSCDKLTDLYANAAQQNYRLWLSSFGSAAPGASGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 117 - protein, 574 aa, Saccharomyces cerevisiae
MAEIKHYQFNVVMTCSGCSGAVNKVLTKLEPDVSKIDISLEKQLVDVYTTLPYDFILEKIKKTGKEVRSGKQLGSAAPGASGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 118 - protein, 920 aa, Saccharomyces cerevisiae
MSEAQETHVEQLPESVVDAPVEEQHQEPPQAPDAPQEPQVPQESAPQESAPQEPPAPQEQNDVPPPSNAPIYEGEESHSVQDYQEAHQHHQPPEPQPYYPPPPPGEHMHGRPPMHHRQEGELSNTRLFVRPFPLDVQESELNEIFGPFGPMKEVKILNGFAFVEFEEAESAAKAIEEVHGKSFANQPLEVVYSKLPAKRYRITMKNLPEGCSWQDLKDLARENSLETTFSSVNTRDFDGTGALEFPSEEILVEALERLNNIEFRGSVITVERDDNPPPIRRSNRGGFRGRGGFRGGFRGGFRGGFSRGGFGGPRGGFGGPRGGYGGYSRGGYGGYSRGGYGGSRGGYDSPRGGYDSPRGGYSRGGYGGPRNDYGPPRGSYGGSRGGYDGPRGDYGPPRDAYRTRDAPRERSPTRGSAAPGASAAPGAGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 119 - protein, 687 aa, Saccharomyces cerevisiae
MDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQGSAAPGASAAPGAGSGSGSGMVVSIIPQFPDIKVSLALFEQVKNAKEIRSKMSELSTSFAFIDPRLVCSGEQMYSAIYKTLIEVKYNKMRTRNLNSECVLCLSPTSNISDAFLKFGIKDDSSQLICLKFHTNTDDVDKEQLRTIMTSIVKGQEIEFNDDNLSRFYDEALIRKIYKLSDDFKPQDVNGLSRALVDAIQLRGV

SEQ ID NO: 120 - protein, 319 aa, Saccharomyces cerevisiae
MRRLYRHLASFFLLPSCPGNTIQSITSYPANALLRSFRHVSTETPVRNRVHNRDSQSCPFFPLMDDGSAAPGASAAPGAGSGSGSGMFAKTAAANLTKKGGLSLLSTTARRTKVTLPDLKWDFGALEPYISGQINELHYTKHHQTYVNGFNTAVDQFQELSDLLAKEPSPANARKMIAIQQNIKFHGGGFTNHCLFWENLAPESQGGGEPPTGALAKAIDEQFGSLDELIKLTNTKLAGVQGSGWAFIVKNLSNGGKLDVVQTYNQDTVTGPLVPLVAIDAWEHAYYLQYQNKKADYFKAIWNVVNWKEASRRFDAGKI

SEQ ID NO: 121 - protein, 326 aa, Saccharomyces cerevisiae
MASIDAFSDLERRMDGFQKDVAQVLARQQNHARQQLQQFQAEMRQLHNQHQHLIDELQRLATQRTALQQQIHAAQQATNTTREQWRSYHERESELSRRQSTLAAQSRELDSLLQQRGKECVQLRARWAAQSGNDAAEVALYERLLQLRVLPGASDVHDVRFVFGDDSRCWIEVAMHGDHVIGNSHPALDPKSRATLEHVLTVQGDLAAFLVVARDMLLASLGSAAPGASAAPGAGSGSGSGMILALGDFLPKQEDKACERPWVQFPARPVIFFHHQGGIFLFSINQPNLSCFSKLKEVNSLYVRVATYICQKNESRFRTNRLKGDQ

SEQ ID NO: 122 - protein, 401 aa, Saccharomyces cerevisiae
MRRLYRHLASFFLLPSCPGNTIQSITSYPANALLRSFRHVSTETPVRNRVHNRDSQSCPFFPLMDDGSAAPGASAAPGAGSGSGSGMGRTFIHASKIKHAARKRKHHSNFRTLIKLLNNDAYKIESSKPLKNGKLFKYWKNRRRLFSKIDSASIYMTDELWFSVTPERIACFLANFVKACMPNAERILDVFCGGGGNTIQFAMQFPYVYGVDYSIEHIYCTAKNAQSYGVDDRIWLKRGSWKKLVSKQKLSKIKYDCVFGSPPWGGPEYLRNDVYDLEQHLKPMGITKMLKSFLKLSPNVIMFLPRNSDLNQLSRATRKVLGPFAKCKVLYVKENGYMKGIFCMWGECFFNYEPASTENSRRESSEKEELSSENEELSKRKKHESTTTTKDNTVDIYDVNG

SEQ ID NO: 123 - protein, 739 aa, Saccharomyces cerevisiae
MGVKQTPPVQVKVSDADSTNRRKSSSQEGNPQLVQLKAKSDKDKRKGSSDSTASIMGSSNALPTKNLTTPPALNPLTTSISRGNTAYERSVNGSRITMHSNLAPTETQDVSWSEIDTLDDVKKMAKEPIVNDGFPRDFESNLTQMRKSHAQLLRLMRERNQRLKYAKLRSPPHKDQHNSATNKDQEPDEVLHDPEIALDGEKYVSQVVDTIKDVHRCGSAAPGASAAPGAGSGSGSGMLLDVNTNHTLMHDAHVHEHCLIKSIRDDGALHSWSDSSKVFYPKSFYATATNKKNNKLASASMNKTATSNRTVSDEIYFHSTKPQFDGQGSAERTRTLTKRNSFKRTRILKARDDSELLNENRSSLMTPSLSSVMSQVRKTNSAKTLSGECPIHEGHLTQSIKRKFSEEAQSDCSSLSSSKLHPLTDDIADAVDLQTPAIGDEVLAEPVVPKMKIININDLDLFDDWEVKDLVDIFPPVYERRPRSSSALSLVSASSDAKLRPTSVDFQIIDKKGGKTSRRKSRSKSTTENMIYENDLVELEQWPSASPSPETDGSIASSELLPNKRIRQKSLNTNFLKLYSIETSCKRKSILPEVEVDDHLLKQLTYSEIRSLEIKKEPNVSTNDIKLALITRKKLWSDMVHETRNDLFGDSTPWNLHFVATTSNTEPSQGRESASEHATADLKSSLVRVHSDVKPWFNNGGTMLKPCGKLNLGKVTNKTSAPTREIQYVVKGWCDSRFL

SEQ ID NO: 124 - protein, 608 aa, Saccharomyces cerevisiae
MSGKASTEGSVTTEFLSDIIGKTVNVKLASGLLYSGRLESIDGFMNVALSSATEHYESNNNKLLNKFNSDVFLRGTQVMYISEQKIGSAAPGASAAPGAGSGSGSGMLLDVNTNHTLMHDAHVHEHCLIKSIRDDGALHSWSDSSKVFYPKSFYATATNKKNNKLASASMNKTATSNRTVSDEIYFHSTKPQFDGQGSAERTRTLTKRNSFKRTRILKARDDSELLNENRSSLMTPSLSSVMSQVRKTNSAKTLSGECPIHEGHLTQSIKRKFSEEAQSDCSSLSSSKLHPLTDDIADAVDLQTPAIGDEVLAEPVVPKMKIININDLDLFDDWEVKDLVDIFPPVYERRPRSSSALSLVSASSDAKLRPTSVDFQIIDKKGGKTSRRKSRSKSTTENMIYENDLVELEQWPSASPSPETDGSIASSELLPNKRIRQKSLNTNFLKLYSIETSCKRKSILPEVEVDDHLLKQLTYSEIRSLEIKKEPNVSTNDIKLALITRKKLWSDMVHETRNDLFGDSTPWNLHFVATTSNTEPSQGRESASEHATADLKSSLVRVHSDVKPWFNNGGTMLKPCGKLNLGKVTNKTSAPTREIQYVVKGWCDSRFL

SEQ ID NO: 125 - protein, 608 aa, Saccharomyces cerevisiae
MSSERACMLCGIVQTTNEFNRDGCPNCQGIFEEAGVSTMECTSPSFEGLVGMCKPTKSWVAKWLSVDHSIAGMYAIKVDGRLPAEVVELLPHYKPRDGSQVEGSAAPGASAAPGAGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 126 - protein, 999 aa, Saccharomyces cerevisiae
MSEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISAQAKQLLLHHTLGNGDFTVFHRMSANISETTAMITDIATAPAEIDRCIRTTYVTQRPVYLGLPANLVDLNVPAKLLQTPIDMSLKPNDAESEKEVIDTILALVKDAKNPVILADACCSRHDVKAETKKLIDLTQFPAFVTPMGKGSIDEQHPRYGGVYVGTLSKPEVKEAVESADLILSVGALLSDFNTGSFSYSYKTKNIVEFHSDHMKIRNATFPGVQMKFVLQKLLTTIADAAKGYKPVAVPARTPANAAVPASTPLKQEWMWNQLGNFLQEGDVVIAETGTSAFGINQTTFPNNTYGISQVLWGSIGFTTGATLGAAFAAEEIDPKKRVILFIGDGSLQLTVQEISTMIRWGLKPYLFVLNNDGYTIEKLIHGPKAQYNEIQGWDHLSLLPTFGAKDYETHRVATTGEWDKLTQDKSFNDNSKIRMIEIMLPVFDAPQNLVEQAKLTAATNAKQGSAAPGASAAPGAGSGSGSGMVSSLPKESQAELQLFQNEINAANPSDFLQFSANYFNKRLEQQRAFLKAREPEFKAKNIVLFPEPEESFSRPQSAQSQSRSRSSVMFKSPFVNEDPHSNVFKSGFNLDPHEQDTHQQAQEEQQHTREKTSTPPLPMHFNAQRRTSVSGETLQPNNFDDWTPDHYKEKSEQQLQRLEKSIRNNFLFNKLDSDSKRLVINCLEEKSVPKGATIIKQGDQGDYFYVVEKGTVDFYVNDNKVNSSGPGSSFGELALMYNSPRAATVVATSDCLLWALDRLTFRKILLGSSFKKRLMYDDLLKSMPVLKSLTTYDRAKLADALDTKIYQPGETIIREGDQGENFYLIEYGAVDVSKKGQGVINKLKDHDYFGEVALLNDLPRQATVTATKRTKVATLGKSGFQRLLGPAVDVLKLNDPTRH

SEQ ID NO: 127 - DNA, 5535 bp, Saccharomyces cerevisiae
taggacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaagatgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctctagtacggattagaagccgccgagcgggtgacagccctccgaaggaagactctcctccgtgcgtcctcgtcttcaccggtcgcgttcctgaaacgcagatgtgcctcgcgccgcactgctccgaacaataaagattctacaatactagcttttatggttatgaagaggaaaaattggcagtaacctggccccacaaaccttcaaatgaacgaatcaaattaacaaccataggatgataatgcgattagttttttagccttatttctggggtaattaatcagcgaagcgatgatttttgatctattaacagatatataaatgcaaaaactgcataaccactttaactaatactttcaacattttcggtttgtattacttcttattcaaatgtaataaaagtatcaacaaaaaattgttaatatacctctatactttaacgtcaaggagaaaaaactataaggatccagctagcaaactcgagtcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcggccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagctgtggtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttct

SEQ ID NO: 128 - DNA, 4899 bp, Saccharomyces cerevisiae
taggacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaagatgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggcctaacagggagttcttcagagacatggaggctcaaaacgaaattattgacagcctagacatcaatagtcatacaacagaaagcgaccacccaactttggctgataatagcgtataaacaatgcatactttgtacgttcaaaatacaatgcagtagatatatttatgcatattacatataatacatatcacataggaagcaacaggcgcgttggacttttaattttcgaggaccgcgaatccttacatcacacccaatcccccacaagtgatcccccacacaccatagcttcaaaatgtttctactccttttttactcttccagattttctcggactccgcgcatcgccgtaccacttcaaaacacccaagcacagcatactaaatttcccctctttcttcctctagggtgtcgttaattacccgtactaaaggtttggaaaagaaaaaagagaccgcctcgtttctttttcttcgtcgaaaaaggcaataaaaatttttatcacgtttctttttcttgaaaatttttttttttgatttttttctctttcgatgacctcccattgatatttaagttaataaacggtcttcaatttctcaagtttcagtttcatttttcttgttctattacaactttttttacttcttgctcattagaaagaaagcatagcaatctaatctaagttttaattacaaaggatccagctagcaaactcgagtcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcggccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggtcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagctgtggtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttct

SEQ ID NO: 129 - DNA, 1461 bp, Saccharomyces cerevisiae
atggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 130 - DNA, 1509 bp, Saccharomyces cerevisiae
atgctgctggacgtgaacacaaatcacacactaatgcacgatgctcatgtgcatgaacattgcctcatcaaaagcatacgtgatgatggcgcattgcactcatggagcgactcatcaaaggtattttatcccaagtcattttacgctaccgctactaataagaagaataacaagttagccagcgccagcatgaacaagaccgccacaagtaataggacggtgagcgatgagatttatttccactccactaagccgcagttcgatggtcaaggaagcgctgaacgtactagaacactaaccaagaggaatagcttcaagaggactagaatactgaaggctcgagacgattccgaactgctgaacgaaaatcgctcatctttgatgaccccgtccttaagctcggtcatgtcgcaagttaggaaaacaaattccgccaagacgttatcgggcgaatgccccatacatgagggccacttaacacagagcataaagaggaagttctccgaggaagctcaaagcgactgttcttcattgagctcctctaaacttcatcccttgacagatgatattgctgacgctgtcgatttgcagacccccgcgattggcgatgaggtactggctgagccggtcgtgcccaaaatgaaaataataaacataaatgatctcgatttgttcgacgactgggaggttaaggatttagtcgatatctttcctcccgtatacgaacggcgtccgcgatcgtcctctgccctttcactggtttctgcgtcgtccgatgccaaacttcgtccgacctctgtggacttccaaatcatcgacaagaaaggcggcaagacttcaagaaggaagagtaggagcaaatcgactacagaaaacatgatttacgaaaatgacctggtagaattagaacaatggccatctgcatcaccatcgcccgagaccgacggttcgattgcatctagcgagctcttgcccaataaaagaataagacaaaaaagtttgaataccaatttcctaaagttatactctattgaaacatcatgtaaaaggaagagtattttacccgaagtcgaagtagatgaccatctgttgaagcagctaacgtattccgaaattcggtctttggaaatcaaaaaggagccaaatgtctctacgaacgatattaagcttgccctaattactaggaaaaaattatggtctgacatggtccatgaaacaagaaatgatctttttggcgattctaccccctggaatttgcactttgttgcaacgacaagcaatacggaaccttcgcaaggccgtgaatccgcaagcgaacatgcaacggcggatttgaaaagttctttggtccgcgtacactcagacgtcaagccatggttcaacaatggcggcacaatgctcaaaccatgcggaaaactaaatttaggcaaagtcaccaataagacttccgcacctacgagagagattcaatatgtcgtaaagggctggtgtgacagcaggtttctctga

SEQ ID NO: 131 - DNA, 150 bp, Saccharomyces cerevisiae
atgtggagacgtcggcgcgagccctgggaggagttatcttttcttcttaacagcttatcaccccggaattggtttatccggagatggggtcttatggctggaagaggccagcacctttgctggctccggtgcgcttgtgacggcccgtga

SEQ ID NO: 132 - DNA, 411 bp, Saccharomyces cerevisiae
atgtcctctgtggaatcttcccccatctcgcgctatgaagacgaggtcttccctctttcgttttcaaacgttgctttcgagccccctatgctctcgcatagcccggacagatcgacttatgccgatgacttttctcaatcttaccagcaagaattgctaacttttccgctatcgtacccgattgtcgatgagtcagaatgcacgcacactaaagataagacggacagcaacataataacgagtactgaagacgattgcatgttcgatatggaatttaacggcaacgccgccagtgcagttgctgctgctagtaaggaatctaactctgcctctgggtttgcctttgcaagtaacgatgcctttgccaatgtcgcacaacagaactacagactgtggttgtcatcggtatga

SEQ ID NO: 133 - DNA, 1179 bp, Saccharomyces cerevisiae
atggcagacacaccctctgtggcagtacaggccccaccgggctatggtaagacggagttatttcatctccccttgatagcactggcgtctaagggcgacgtgaaatatgtgtcgtttctgtttgtaccgtacacagtgttgcttgctaattgcatgatcaggttgggccgacgcggttgcttgaatgtggcccctgtaagaaactttattgaagaaggttacgatggcgttactgatttatacgtggggatctacgatgatcttgctagcactaatttcacagacaggatagctgcgtgggagaatattgttgagtgcacctttaggaccaacaacgtaaaattgggttacctcattgtagatgagtttcacaactttgaaacggaggtctaccggcagtcgcaatttgggggcataactaaccttgattttgacgcttttgagaaagcaatctttttgagcggcacagcccctgaggctgtagctgatgctgcgttgcagcgtattgggcttacgggactggccaagaagtcgatggacatcaacgagctcaaacggtcggaagatctcagcagaggtctatccagctatccaacacggatgtttaatctaatcaaggagaaatccgaggtgcctttagggcatgttcataaaatttggaagaaagtggaatcacagcccgaagaagcactgaagcttcttttagccctctttgaaattgaaccagagtcgaaggccattgtagttgcaagcacaaccaacgaagtggaagaattggcctgctcttggagaaagtattttagggtggtatggatacacgggaagctgggtgctgcagaaaaggtgtctcgcacaaaggagtttgtcactgacggtagcatgcaagttctcatcggaacgaaattagtgactgaaggaattgacattaagcaattgatgatggtgatcatgcttgataatagacttaatattattgagctcattcaaggtgtagggagactaagagatgggggcctctgttatctattatctagaaaaaacagttgggcggcaaggaatcgtaagggtgaattaccaccaattaaggaaggctgtataaccgaacaggtacgcgagttctatggacttgaatcaaagaaaggaaaaaagggccagcatgttggatgctgtgtctgctga

SEQ ID NO: 134 - DNA, 447 bp, Saccharomyces cerevisiae
atggactcgtactcaataacaaacgtaaaatacctggatccgactgaattgcatcgttggatgcaagaaggacacactactacgctgagggagcctttccaggtagtggatgtgcgaggctcagattatatggggggccatatcaaggacggatggcactacgcctattcgcgccttaagcaggatccggagtacttacgtgagctaaagcacagattgttggaaaagcaagcggacggccgcggagcgctgaacgtgattttccattgtatgttatcgcagcagcgcggaccgtctgcagcgatgctgctgcttcggtcgcttgacacggcggaactttctcgctgtcgtctatgggtgttgcgtggggggttctcgcgctggcaatccgtatacggtgacgacgagagcgttacggcgggttacctacccgatctgtggcgttga

SEQ ID NO: 135 - DNA, 651 bp, Saccharomyces cerevisiae
atgtccgataaagttattaaccctcaagttgcatgggctcaaaggtctagtactactgatccagaaagaaattatgtcttaataactgtgtcaattgcagactgtgatgcccctgagttaaccattaagccatcatacatcgaattaaaggctcaatcaaagcctcatgttggcgatgaaaatgtccatcattatcaattacacattgatctatacaaggaaattatacctgaaaaaacaatgcataaggttgctaatggccagcactactttttgaaattgtataaaaaggatttagaatctgaatactggccacgtttgacaaaggaaaaggtgaagtacccttacatcaaaactgatttcgataaatgggttgatgaagatgaacaagacgaagttgaagctgaaggtaatgatgccgctcaaggaatggatttcagccaaatgatgggaggtgctggaggtgctggaggtgctggaggcatggacttcagccaaatgatgggaggtgctggtggcgctggttctccagatatggctcaattgcagcaattattggctcaaagcggtggtaatttggacatgggagatttcaaagaaaacgatgaagaagatgaagaagaggaaatagagccggaagtgaaagcttaa

SEQ ID NO: 136 - DNA, 305 bp, Saccharomyces cerevisiae
atggttcagtacgctccctttctattaggaaagtatgttcattcttcatacgctattctatttttttttttttcacacttattcttttactaacgcatagttaaccatttgctgtttcgaagaggcaacatcaaacaagtcgatgtgctctttcccaagctggtctctattgcagattttctgatccgttattggcaattatggtaggctgtctcagctactatgtgtacgaaaggaaaatggggcgtccacaaggtcatcatttacacgagctcataaagaagcgatgggacgatcgcaaataa

SEQ ID NO: 137 - DNA, 1818 bp, Saccharomyces cerevisiae
atgcagacgtcaatggtgagcgcaaaagttagtatatggctagtatgtagcgttatatgcagtagcctggtacgggctacgcaatctgtgtgttcgtcgcaaaacacagcgaccactgacggtgtacgaaatcaatttcagagtaatggttggtgttcaaataactgtgctggtcatcagtttgccatcgtacaggggttcatgtgctggtgcagtgattcggaaccgagcactcagacatcggtgggagactgcagtggcacttgtcccggttatggctacgaagattgtggtaatgcggataaggatctttttggttatatatatctggggcaaaccccgctaagttctgtacagagtgtggaaacgtcaacagagtccagtgtgtacgtttcaagtagctctatcacgagtagtagtagtacgagtattgtggacacaaccacaatctcgccgactctgacgtcaacgagtacgaccccattgacaaccgcctcaaccagtacaacaccatcaactgatataacatcggcactgcccacgactacaagcacaaagttgtcaacatccattcccacaagcacgacatcgtcaacctctaccaccacaagtacctcatcgtcgacttctacgaccgtaagtgtcacatcatcaacatctaccaccacaagtactacgtcgtcaaccctcatttccacgagcacatcatcatcatcatcatcaactccaaccacaacatcgtcagcccccatttctacaagcacgacgtcgtcaacttccacttcaacaagtacaacatcgccaacttcttcttcagcacctacaagctcgtctaatacaacaccaacgagcacaacgttcactacgacatcacccagtacagccccttcaagcactacggttacttacaccagtaccacagcatctccaataacgtccactataacttctgtaaacctgcagacctccttaaagtattctgtgataacagtgacttcagtgcacaccatggacactaacatttcggaaatcacctcgagatatctcaccatgaaaaaagtaataacgcagatttactcttccaccctcggggctactcctacttctgcagtggctactacgtctgccagcgtaggtggtagaataacaaacaataacaatagtaacaccaccaacagcaatacaccaactaacaagtctacagaaaagaaagggtactgggattcgcccgggaaaatagccgctactttcgtcgtggttggagtggtatgtttggtaattatatgcatactaatatacttaatacatcattatagaacaagacccgctcggaaggctcaagattttgagaatgaatatcagagtaagttttaccagtccaagtacccaaatgaagttaccactaccacgttacacacgccttcaccatcttcaaattcaactttctcgaccccaagattaatatacactgatgaaaagggacaaattatgtctgaatcaccatccccacgtcaatctacgtattccttgactgcaggcagtccaccaaatgacccaagcacgttggcaagcccatttcacgatcccattcttcccagaagaacttctacttttcttcattcgcccattcaaaagcaacacgaaaaaatggaatcaaacgttactctaggtgaagacacggtactggtggatcagaggctagacccaagtaagatgcttaacactttagcaaatgacgatgccacaaaccactctaccatttcgttatcagacaacgtagactactccaggagggttctgcggctaatgaacgaataa

SEQ ID NO: 138 - DNA, 537 bp, Saccharomyces cerevisiae
atgaccttgtggccacatccggggtcatacaagatcaagtcagcaactttgttctgcagcagagacaagttggggtgtgctttcttgtcggaaagttccctttgcatgtatttcttatataactctctgtctatctgggctctgggcccccacacagcaggacccttgcttctgttcagcattttgaattgcactccagcgagatcagttactttgcccatcagcccatcgagagcgtcgatttcctttacaaggatgcccttacccactccaccaatagaggggttgcacgaacacttaccaatatctgttaacgatggtgtaatgagagtagtatgcgcaccagtcctagatgacgcagctgcagcttcgcagcctgcatgtccagcaccgatgaccacgacctgtgtcttggttgtgggttggaagcttgtcaaagaagatatggtcaaccgcctcctgaggacctgtaagggaaatgaagtacacgaagacgccaaggttgttacacgcagcatcgttctttggggcgtttag

SEQ ID NO: 139 - DNA, 1974 bp, Saccharomyces cerevisiae
atgcttaaatctggtagactcaactttctcaagttgaatatcaattcacgattactatactcaacgaaccctcaactgactaagaaggtcattggtatcgacctgggtaccacgaatagtgctgttgcatatatccgtgattctaacgacaaaaaatcagctacaatcatagaaaatgatgaaggacaacgaaccacaccatctatagttgcctttgatgtcaaaagctcgccacagaataaagatcaaatgaaaactcttgtagggatggcagctaaaaggcaaaatgctattaattctgaaaacactttctttgctacaaagagacttattggccgtgcattcaacgacaaggaagttcagcgagatatggctgttatgccatataagattgtcaaatgtgagtcaaatgggcaagcctatctcagcacgtctaatggtctcattcaatcaccaagccagatagcatctatattactgaaatacctgaaacaaacttcagaagaatacttaggcgaaaaggttaatttggcagttattacagttccagcatattttaatgattctcaaaggcaagccacaaaagatgccggcaagttagctggcctaaatgttttgagagttattaacgaaccaactgcggccgccttaagctttggaattgatgataagaggaataatggattaattgcagtttacgatttgggtggtggtacatttgacatatccatcttggacattgaagatggcgtgtttgaggttcgtgctactaatggtgacacgcatttaggtggagaagattttgacaacgtcattgtaaactatattatagataccttcattcatgaaaaccctgaaattacacgggaagaaattacgaagaacagggagacaatgcaaaggttaaaagatgtttctgaaagagctaagatagatttatcccatgtgaagaaaacttttatcgaacttccatttgtatacaaaagcaaacatctacgagtgccaatgacagaggaagagctggataatatgactttgtcattaatcaacaggactatcccacctgtgaagcaagcattgaaagatgccgatatcgaaccggaggatatagatgaagtaatccttgttggtggtatgacccgtatgccaaagattagatctgttgtaaaagatctttttggtaagtctccaaattctagtgttaacccagatgaaacagttgctttaggagcagctattcaaggtggtattctatccggtgaaataaagaatgtcttacttttggatgtgacaccattgacattagggattgaaacatttggaggagcgttctcacccttgatacctagaaatacgacagttccagtaaaaaaaacagagatatttagtactggtgttgatgggcaagcgggtgttgatatcaaagtttttcagggtgaaagagggttagtgcgtaacaacaagttgattggtgatttgaaacttacaggaatcacccctttgcctaaaggcattccccaaatatatgttacttttgatatcgatgcggatggtatcatcaacgtatctgccgctgagaaaagtagtgggaaacaacaatccattactgtaataccaaattctgggttaagcgaagaggaaattgcaaaacttattgaagaagcaaatgcaaatagggcacaagataacttgatcaggcaaaggttagagcttatctctaaggctgacattatgataagtgatactgagaatttatttaaaagatatgaaaaactgatttctagcgaaaaagagtattctaatatcgtagaggacatcaaagctctgagacaagctataaagaattttaaggctaacgaaaatgacatgtcaattgatgtaaacggaataaaaaaagctacggatgcgctacagggtagggcattaaaattattccaaagcgcaacaaaaaaccagcagaatcaaggtaaataa

SEQ ID NO: 140 - DNA, 1629 bp, Saccharomyces cerevisiae
atgggcaatcagtcattagttgtgcttacggaaagtaagggtgagtatgagaatgagacagaactacctgttaaaaaatcgtcacgagataataatatcggagaatctttaacagcaacagcttttacgcagtctgaagatgaaatggtagatagcaatcagaaatggcagaacccaaactattttaaatatgcatggcaagaatatctttttatattcacatgcatgataagtcagcttctaaatcaagcaggcactacacagactctttcgatcatgaatattctttcggacagttttggctcagaaggaaactcaaagtcatggctgatggcatcttttccgctagtttcaggctcatttattttgattagtggcagactaggtgacatatacggattaaaaaaaatgttgttagtaggatatgttctggttattatatggtctttgatttgtgggattaccaagtattctggtagcgatactttttttattattagtagagccttccaagggctagggattgcatttgttttacctaatgtgctgggaataattggtaatatatatgtaggtggtacttttcgtaaaaacatcgtgattagttttgttggtgcgatggcccctattggagcaactttaggttgtctttttgcaggactgatcggtaccgaggacccaaaacaatggccatgggcattctacgcgtatagcatagccgctttcattaattttgtgctctccatatatgccattccgagtactataccaacaaatattcatcatttttctatggattggattggttctgttttgggcgtgataggtctcattttattaaattttgtgtggaaccaagctcctatatcgggttggaaccaggcttacatcatcgtaattttaatcatttctgtgatttttcttgtcgttttcatcatttatgagattcgatttgccaagactccactattgccgcgcgcagttataaaggatcgtcatatgattcaaattatgctggctttattctttggatggggctcttttggcatctttacgttttattatttccaatttcaattaaatataaggcagtacacggcattatgggctggtggaacttactttatgtttttaatttggggtattattgccgccttactggtaggatttactatcaagaatgtgtctccatcagtgtttttgttcttttctatggtagcattcaatgtgggctcaataatggcaagtgttacaccggttcacgagacatactttcgtactcagttaggaacgatgataattttaagttttgggatggatctttcatttcctgcttcttccattatctttagtgataatttaccgatggagtaccaaggcatggctgggtcattggtgaatactgttgtcaattactccatgtccttgtgtctcggtatgggtgccacagtagagacacaggtcaattcagacggaaagcatcttttgaaaggctatagaggtgctcagtaccttgggataggattggcaagtttagcatgcatgattagcgggctttacatggtcgaaagcttcataaaaggccgcagggcaagagctgctgcagaatacgattgcactgtggcttag

SEQ ID NO: 141 - DNA, 504 bp, Saccharomyces cerevisiae
atgaacaacgagactagtggtaaagaaacggcgtctgcacctctgtgttcgcccaagttacctgtagaaaaagtgcagagaatagccaagaatgatccagaatatatggacacttcggatgacgcattcgtagccacagcgtttgctacagaattcttcgtccaggtgctgacacatgagtccctacataggcaacagcagcagcaacaacaacaggtaccgccgctcccagatgaactcacgctgtcgtacgatgacatctctgccgcaattgtgcactcttctgacggccatctgcagtttttgaatgatgtgataccaacaacaaagaatttgaggcttctagtggaagaaaaccgagttagatatactacaagtgtcatgccccctaatgaagtttactccgcctatgtggtgaacgatacggctccgaagcccaacattgtcgagattgatcttgataatgacgaagacgacgacgaagacgttactgatcaagaataa

SEQ ID NO: 142 - DNA, 882 bp, Saccharomyces cerevisiae
atggcatctgtgaacaattaccaggttgattgcgggtcaaggtctgctcgcattcaacccagaattaataacggcattcacgatgaagaatcgctatttgaagtcctggaactctcagaagaggaatttgagctagacttccatagattaaagtcattcaatgatgtaagggttatcaataacccagatttatctccagaatgtacaaatactgccattagtcgcgatgagacactggaatctgcaagtagtgccttcgaagttccttctgacgaaattgctatactgtcgatatccagtgacagcaataaaaattctccgccctcagagcagccggcgcccgctcttcgtaacattcgatcgtctagtaactctgaccggatcgatgagtggtgtttgggcagccatttatttaatgagctgcatcaaaatgtccctcaatcaagcgacggtgtcaatcatggatttcccgtttattcctttaaggaaagagaactttatacctctgcgaaattaaagaaacttacaaatgcccaaagaattgctgtgcagaaactatcaagagacttgtatccaattctaagaacatgctaccgcgagaaaactcgccggcaattattgacataccatcatgaaagaatatttgacgatataccatcttttttcccccagcgtgactttattttcaattactactcgatgcctcttgaattcgacaggttgtcagacgtagatatagattcgtcatcgcggtcacgatttacagatgagagcactggagaaacattaaaccgttcaccaagcgcagcgtcttcgtcgttggaaaacacatcttggtttggctggactttactttctaggtttttggacagagaatggtag

SEQ ID NO: 143 - DNA, 201 bp, Saccharomyces cerevisiae
atgcgccgcctatatcgtcatcttgcttcctttttcttactcccttcctgccctggaaacaccatacaatccatcacatcatatcctgccaatgcactattacgcagctttcggcacgtgagtacggaaacaccagttcggaaccgggtacacaatagggatagtcaaagctgtccattttttccgctgatggatgactga

SEQ ID NO: 144 - DNA, 1602 bp, Saccharomyces cerevisiae
atggagcgattgaagcaactggaggaaaaaaggagacaattgaaagagctgcgtgagaggcgaaaacaagccagcttgttccctgggagcgagacgatgggccaccatcccacagaggtgcacgctaaggcaaccatggtcagcgtttcagtgcagaccgacatggaggaaggctcaaagattcaagagccccaatctgcatatcttcgacgtaaggaggttataacatacgacaaaggcattcaaacagatcaaattgaggaagaacaactgcaagaaaatgaaaatcacaccactactgatgctgtcgccattgaaactactgctgccgacgaaaataataaagacaaagctgaaaacgaccagccaaggttagaactagccaaaccttttcttgttgaagaggcggcggcaacgctgagcaacgctagttttgcgcggctggagacagaggtttctgcgtcaggccagcaggcgccatcgaacatgcaacaggataaagacaacctcatgcaatggaacatggtcagtgagaatttacaatcagagacagactgcgattgtatcgctcaggagtatgacccaggaaaaggcgtcttggttgtggtttatctacgattgccgccggcagacctacagtatgctagcagcgaagcggcgtggtctgtggtgaatgtagtcaagtgcgataatgccagcggacgcaacggcctcttgatagatatggtagagttccgtggtacgcggatcatgacagccacgatcctccgtcggtatcatccggaaagcaatgtaatatcaatcttgttggcgaccttgacgggcaagatcatattgtacgagcttagattgaaacagaaaaagccagaaacaccggtagtgtatgtcgtgcagcgaaatatggtggcaagacactactttcagcacccagtggtggctgtaattgaaacaagcagcgtgcaagatcaagagagagtacttgtggcagctgataatggcaatattatggagttgagctgcctggacttgactgttttgcggaagccacagcagctccgtcctgtaccgctatcacagcttttatctttggagaatgatacttgcacatatacggagcgattgcagcggttggcaaagtttgatgaggtaggtatagcttgcatggcgtacacgagtgaggacccgcagtacgtctggatcggtggcgaagacggtggtatatacaaggttttctgggaccaacctgggccgctgtacctctctttggacaacaatgggttccaacctgcagaaaaccactctacgagggtaaccgggttagagtttcattgggacgatgctcggcggctaatgcttctattatcatgttccacggactggacggtgcggctgtgggacgcgcgagcagggaaagctatcataggggcgccattgttgttaggggggcccgtactacgtgcacgctggctcgaaaaaaacaatggaggggaaaatagtcgcactctacggtgtcaagtgtggtgtgcagatggtcgcctcgttgttgtaaattgggctttcgatgctaagacgtccctctacacggccactgttatctcctaa

SEQ ID NO: 145 - DNA, 652 bp, Saccharomyces cerevisiae
atggtagtatccatcataccgcaatttcctgatatcaaggtttcactagcattgtttgaacaggttaaaaatgctaaagaaatacgctctaaaatgagtgaattgtcgacatcctttgcctttattgacccccggttagtctgttcgggggagcagatgtattctgcaatttacaagaccttaatagaagtgaaatataacaagatgagaacaagaaatttgaattccgagtgcgtactatgtctttcacccacttccaatattagtgatgctttcctcaaattcggaatcaaagacgattcgtcacagttaatatgccttaagttccatactaatactgacgatgtagacaaagagcaattgaggacgattatgacttctatagtaaaaggacaagagatcgagtttaatgatgacaatttatcgagattttatgacgaagcgctcataagaaaagtatgttttaataataaattcgaggtaaaaacttcaacagcctcaccagaaacacattgtactaacttcacctttgttttccttttattttgtttttacctattagatctataaattaagtgatgatttcaagccccaagacgtaaatggtctctcaagagctttggtagacgctattcaattgaggggtgtgtag

SEQ ID NO: 146 - DNA, 117 bp, Saccharomyces cerevisiae
atgtccctacggccttgtctaacaccatccagcatgcaatacagtgacatatatatacccacacactctctcacatctacctctactctcgctgtcataccttacccggctttctga

SEQ ID NO: 147 - DNA, 1944 bp, Saccharomyces cerevisiae
atggaagctggcaggagtgctgatgaagtgctataccacaatcagtcgtcagtaaagttaggtgagttagaaagatacgttattacatatgagctataccagggtgatagtattcccgctgatatcacactggattccctatgggtaaagatcaaaaataccacaaagctatcctataaaccagcctatctattgggcccatttatcttatattgtgacgtgcgagcaaaagattacgaaagctcgtataagatcatatgttcggcggataaaccagtatttcaatcaaacctacaggcacaacaaaagtttattgcagagttgtccttgcaccacattaagccacgctatgtatggatagtggatattgtcagtcaaatactatttaataaagaaactaaggtaacttttgagatagtagtcggcaattcaaaggcctctttgaaaagaaaaatacgatgtaatgattcattgcctgataaagcctgcaatattttacacacaggattatcggtgcatagacttaccaccgcagatatatggaaagtaccacgacccatagacatgtcgcaaaaatcccatttagtcattctcacgcatggttttcaatcaaacgtttcggcagatatggaatacttaatggaagaaatatacaaggctcaaatgaacaatccaaatgagcgactagttattaagggatatatgaagaatgcttgtgagactgagaagggtattaagtttttgggtgttggattggcaaactacatcatcgacgagttatatgatgactctgttgggaaaatttcatttattggtcattccctgggtggattaacacaaacttttgctatttgttacataaagaccaaatatccatatttctttaagaaagtggagccaatcaattttatctcactggcgtcaccattgctaggcattgctaccagcacgcccaattacgtaaaaatgtcattgtcgatgggtatcattggtactacggggcaagaactgggtcttaaggatggaaattatggtgataagcccctactttacctgctatccgaggaatccttaatcagtgtgcttgctcgattcaaaagaagaacactttatgctaatgccgtcaacgacggaatagttcccttgtactcctcttctttactttttttggactactctcaattacttcagaaactgggaggtcaaactacggcaccttgtgatcctctcttccagcctgaagtaagtcctattggggaacttccaaatcatagcgatgttgctaatgatgatgatggaatcaatgcatcgtcatggaacacgttttggaagagcaaggaaaataactgcgacaagaaatctaaacgcttgatgaatgcttccgtcatcaaatctatgaagtctgtgcttctatcaccatgccccgacgcaaagttcttctcagatcccgatgcaagggtcgcaacaatcatacatgataagatctacacagaaaagaatttaccgcctccatcaccaacactttatgaaggaacagcagccaaggaaggcgaaacgaggaagacgagaaaagagatggaggaaatcatagcacgccgctggcacaaggggatgcattggaggaaagtcgtggtattgctgaaaccagatgcccacaataacatcatcgtaagaagaaggttttccaacgcttacggctggccggtggttgaccaccttgttaccgcccatttccaaagagatgacccaatcgcctcaccaatgcaagataaacagtttgctgaggaagatataaacatggcaaccggaggggtggaaccaaacaagttctactcatggctcaccaagatcgaggatcctagtgtgtaccatggtggaatagtctccacagctagccagctcgccagctcctggattagcaagcattcctctgtgacagattga

SEQ ID NO: 148 - DNA, 315 bp, Saccharomyces cerevisiae
atggtcactcaattaaaatccgcttctgaatacgacagtgctttagcatctggcgacaagttagtcgttgttgacttttttgccacatggtgtgggccatgtaaaatgattgcaccaatgattgaaaagtttgcagaacaatattctgacgctgctttttacaagttggatgttgatgaagtctcagatgttgctcaaaaagctgaagtttcttccatgcctaccctaatcttctacaagggcggtaaggaggttaccagagtcgtcggtgccaacccagctgctatcaagcaagctattgcttccaacgtatag

SEQ ID NO: 149 - DNA, 489 bp, Saccharomyces cerevisiae
atggtgatgctccattctaaaaacgttaaagggtttctggaaaacactttgaaaccgtatgatttgcattcggtagacttcaagacatcgtctttgcaatcgtctatgattataaccgccactaatgggggtatactgtcctatgcgacgtcaaacaacgatgtaccgaaaaattccataaacgaaataaactcggtcaataacttgaaaatgatgagcttattgattaaggataagtggtcagaggatgaaaacgatactgaggaacagcactccaatagctgttaccctgtggaaatcgactcctttaagacaaaaatatatacttacgaaatggaagatttacatacctgtgtcgcacagatacccaatagcgaccttttgctattgttcattgcggaaggtagcttcccttacggactactggtaattaaaattgaaagagctatgagagagttgactgatttgtttggctacaagctaggttga

SEQ ID NO: 150 - DNA, 309 bp, Saccharomyces cerevisiae
atggcaggggatagtataagcgctgacggcactggcgtccatccagttgaactgtcggtgtattcagtattgtccaccgatttagacggactgtatcaatcgatcaatgaattacgcgagtcgcaagcactactcatccttatgcttcggaaggttcgcgataaacttcgaagagaaggtcaagtcctttatgacccagaaccattcaaaccaaccatggataaactggctgacttatctgcccgtgtgcgcattctctcacaaagatacgaggagcttcaggggaatgctagagccctcaacaactaa

SEQ ID NO: 151 - DNA, 1377 bp, Saccharomyces cerevisiae
atgggtaaagagaagtctcacattaacgttgtcgttatcggtcatgtcgattctggtaagtctaccactaccggtcatttgatttacaagtgtggtggtattgacaagagaaccatcgaaaagttcgaaaaggaagccgctgaattaggtaagggttctttcaagtacgcttgggttttggacaagttaaaggctgaaagagaaagaggtatcactatcgatattgctttgtggaagttcgaaactccaaagtaccaagttaccgttattgatgctccaggtcacagagatttcatcaagaacatgattactggtacttctcaagctgactgtgctatcttgattattgctggtggtgtcggtgaattcgaagccggtatctctaaggatggtcaaaccagagaacacgctttgttggctttcaccttgggtgttagacaattgattgttgctgtcaacaagatggactccgtcaaatgggacgaatccagattccaagaaattgtcaaggaaacctccaactttatcaagaaggttggttacaacccaaagactgttccattcgtcccaatctctggttggaacggtgacaacatgattgaagctaccaccaacgctccatggtacaagggttgggaaaaggaaaccaaggccggtgtcgtcaagggtaagactttgttggaagccattgacgccattgaacaaccatctagaccaactgacaagccattgagattgccattgcaagatgtttacaagattggtggtattggtactgtgccagtcggtagagttgaaaccggtgtcatcaagccaggtatggttgttacttttgccccagctggtgttaccactgaagtcaagtccgttgaaatgcatcacgaacaattggaacaaggtgttccaggtgacaacgttggtttcaacgtcaagaacgtttccgttaaggaaatcagaagaggtaacgtctgtggtgacgctaagaacgatccaccaaagggttgcgcttctttcaacgctaccgtcattgttttgaaccatccaggtcaaatctctgctggttactctccagttttggattgtcacactgctcacattgcttgtagattcgacgaattgttggaaaagaacgacagaagatctggtaagaagttggaagaccatccaaagttcttgaagtccggtgacgctgctttggtcaagttcgttccatctaagccaatgtgtgttgaagctttcagtgaatacccaccattaggtagattcgctgtcagagacatgagacaaactgtcgctgtcggtgttatcaagtctgttgacaagactgaaaaggccgctaaggttaccaaggctgctcaaaaggctgctaagaaataa

SEQ ID NO: 152 - DNA, 342 bp, Saccharomyces cerevisiae
atgacaagcaaacgggaaaagtcactggatcacacattgtaagtagaagcagtttttcaatgggaagaccgcactgcatagtttactaactatttaaactttccaaacattagagaactaaagataccgtttgaaacggagcgacaagcgaccatagcaaccaaagtcctatctccggacccgattttgaagccacaagattttcaagtagactacagttccgagaaaaatgtcatgctagtccagttcagaagcattgatgatagggtgcttcgagtgggagttagcagtatcatagacagtatcaaaaccattgtggaagccatggacgttctatcataa

SEQ ID NO: 153 - DNA, 435 bp, Saccharomyces cerevisiae
atgggcaagaaagcacacggaggaaagatgaaacctgagatcgacgaaaatggtactctgctagtaccgccaccaaggacgattgcgaaccaggaccatttccatagattaaactacctctaccaaatatccgcttaccaaacaagagcaagacagaaagcaagaacagacgcacatacgcctttggcacgcaattatatcaaatcaatggacctaattagtaagaaaaccaagacatcactgcttcctacgataaagagaacaatttgtaaaaaatgccatcggttgttatggaccccaaaaaaactggaaatcacatccgacggagcgctttcggtaatgtgtgggtgcggtaccgttaaacgttttaatattggcgccgatcctaattacaggacctactcggagcgggagggtaatctactaaattcttag

SEQ ID NO: 154 - DNA, 372 bp, Saccharomyces cerevisiae
atgaaactaccggtagcacagtacagtgcaccagatggtgtggaaaaaagttttgcaccaatacgcgatgaccctcgatacatgaccacagagggaaggacaactgggcccagtgaccatgtgctaaacgctggccaaatcgatagagacaaaccttcagaaccggaacgcacgaaagatggctcacaactgacatacttaggccagctgcgcacgcagctgacggggctacaggacgatattaacgagtttttgacaggaagaatggaattggcaaaaaataagaagaaagccggcgcagacgagaagcggatccaggaagagattaaccagctattagatggtggtgacggtgacgaagatgctgtttag

SEQ ID NO: 155 - DNA, 474 bp, Saccharomyces cerevisiae
atgtctgacgaagaacatacctttgaaactgctgacgctggttcctccgccacctacccaatgcaatgttctgccttgagaaagaacggtttcgttgtcatcaagagtagaccatgtaagattgtcgacatgtccacttctaagactggtaagcacggtcacgctaaagtccatttggttgccattgatatcttcactggtaagaagttggaagatttgtctccatctactcacaacatggaagttccagttgtcaagagaaacgaataccaattgttggacattgatgacggtttcttgtctttgatgaacatggacggtgacactaaggatgatgtcaaggctccagaaggtgaattgggtgacagtttgcaaactgcttttgatgaaggtaaggacttgatggttaccatcatctccgctatgggtgaagaagccgccatctccttcaaggaagctgctagaaccgattaa

SEQ ID NO: 156 - DNA, 633 bp, Saccharomyces cerevisiae
atgatgagtcaagtatcgcattcccaagaaggatccgggcgattttggaacaagtttaagtcgtcaaccaaatcgttatctacatcgttggcacatttatccattaaagcagaaaaagatggtgatactgtaaatactacattggtccataaagggcttgtgaaattctatgaaaatcagcatcctttccaggggttcccaggatggttgggggagaaggaagatttaccgaacgaacgtaaaatattagatactcaagtgaagcatgatatgaagaagcaaaactcgcgtcatttctcgccatccttttctaacagaaggaaggcttcttcagaagatcctatgggtacaccttcttcaaacgggaacacaccggagtacacgcctgcgagtaaatcgtttcaagatatatacaataatcatacaagctcctctagcgcgacaccgagaagagcttcatcacggccgactagaccttcagcaggccaagaattcagggcaagtctcggtcgaagtaaaacgtcgaacagtttcaacacctccagcacgccaacgccgccaccagacgcaagtagtggagtaatggcaatgaaggacagactaaagagacgcaataacgattatggattttaa

SEQ ID NO: 157 - DNA, 717 bp, Saccharomyces cerevisiae
atgtcccacaaattaacaatcctgccatttctgattaagttcacgcccaagtttccacaatccattgatcacgacgagcatggtctaaacgtttatgcctttgatctggaccatacaattatcaaaccaaagtcccccaatataagttttagtagaagcgcaagtgattggcagtttattaattttaactccaagaaatccaccctggattacctgtgtaatatcattgataatgatcccacggccgtcatagtcatattttctaaccaaggtggtgtcatcaccgtcccaagaacttctaaaagttgcaccaagtacactaataaaattttgctatttttaaaggcaatcaaaaacgatgagagaggagaaacgttatcacacaggttatggctatatgcagcacctaaaaggccgaaaacttttgcagcaaatcatagtaagatcacattcgcaagcttaggtgaaagttataacaatgatcctaacatattcgaaaaagttcgaaaaccaatgacaggaatggtagagttttttaaaagggacctggaaagtgcatacagggtttcagaacaaatttctcccatcaagttgaattggatatattattgcggtgacgctgctgggaggaaaaaggacttcagtgattctgacataaagtttgctgaaaacttgcacgttgaattcaagtaccctgaggaaatatttcacgggtag

SEQ ID NO: 158 - DNA, 186 bp, Saccharomyces cerevisiae
atgttcagcgaattaattaacttccaaaatgaaggtcatgagtgccaatgccaatgtggtagctgcaaaaataatgaacaatgccaaaaatcatgtagctgcccaacggggtgtaacagcgacgacaaatgcccctgcggtaacaagtctgaagaaaccaagaagtcatgctgctctgggaaatga

SEQ ID NO: 159 - DNA, 477 bp, Saccharomyces cerevisiae
atggtgacagggggaatggcaagcaagtgggatcagaagggtatggacattgcctatgaggaggcggccttaggttacaaagagggtggtgttcctattggcggatgtcttatcaataacaaagacggaagtgttctcggtcgtggtcacaacatgagatttcaaaagggatccgccacactacatggtgagatctccactttggaaaactgtgggagattagagggcaaagtgtacaaagataccactttgtatacgacgctgtctccatgcgacatgtgtacaggtgccatcatcatgtatggtattccacgctgtgttgtcggtgagaacgttaatttcaaaagtaagggcgagaaatatttacaaactagaggtcacgaggttgttgttgttgacgatgagaggtgtaaaaagatcatgaaacaatttatcgatgaaagacctcaggattggtttgaagatattggtgagtag

SEQ ID NO: 160 - DNA, 1055 bp, Saccharomyces cerevisiae
atggctagaggaccgtatgttgatttccacctaaaaaaatgaagagttggcaaaacaagataatagttttctttgaagatgggtaccctctcatgattggtacaagtgatttgcaccaaagtgacgatgcggactaaagaaagaatataagagttgtgtttatctatctggaagatagaattctgatgagaaactttatccttgttaagtaacagataagcattgcgggatatttttactaacaagagtacgtttaataatgttaatacgatttttcatatagaaagaagcatctaaagagattagcagctccacaccattggttattggacaagttgtccggttgttacgccccaagaccatctgctggtccacacaaattgcgtgaatccttgccattgattgtctttctaagaaacagattaaagtatgctttgaacggccgtgaagtcaaggctatcttgatgcaacgtcacgtcaaagttgacggtaaggttagaactgacaccacctacccagctggtttcatggacgtcatcactctagatgccaccaatgaaaacttcagattggtctacgatgtcaagggtagattcgctgtccaccgtatcaccgatgaagaagcctcttacaaattgggtaaggtcaagaaggtccaattaggtaagaagggtgttccatacgttgttacccacgatggtagaactatcagatacccagacccaaacatcaaggtcaatgacactgttaagattgatttggcctctggtaagattactgatttcatcaagttcgatgccggtaagttggtttacgttactggtggtcgtaacttgggtcgtatcggtactatcgttcacaaggaaagacacgatggtggtttcgatttggttcacatcaaggactccttggacaacactttcgtcactagattgaacaatgtcttcgtcattggtgaacaaggtaagccttacatttctttgccaaagggtaagggtatcaagttgtctattgctgaagaacgtgacagaagaagagctcaacaaggtttgtaa

SEQ ID NO: 161 - DNA, 786 bp, Saccharomyces cerevisiae
atgacgcaagaattcattgataaagtatcttcctacctgactcctgatgtggacattgcacctatttctcaaggtgcagaagccattgttttcacaacgactactcacccatatctcccaagagcaaaggattctcatcaaaagtatattatcaaatataggccaccaaagcgttatagacatccacaaatagaccaggcactaacaaaacatcgtacgttgaatgagtcgcgtttattggccaaattatacttgattccagggctatgtgtccctcaactgatagcgtgtgatccatacaatggattcatttggttagagttccttggagaagatcttcccggagggcacggttttagtaacctaaagaacttcctttggatgcatgaccaagatccatatagtgatcttgtagcaactacactacggaaagtggggcgccaaattgggttgttgcactggaatgactactgtcatggtgatttgacaagttctaacattgttctcgtgcgagatggtgcgagatggacgcctcatttgattgatttcggtctgggctcagtttcaaacctggtcgaagataaaggcgtcgatttatacgtcttagagagagctattttaagtacacattcgaagcatgcggaaaaatacaatgcttggatcatggaggggttcgaagaggtctatcgtgaacaaggtgcgaaaggtgccaagaaactgaaagaagttaccaaaagattcgaagaggtcaggttgcgtggtcgtaagagaagtatgctaggataa

SEQ ID NO: 162 - DNA, 1161 bp, Saccharomyces cerevisiae
atggtcaacttgaacactatcccacccaaaaatggcagggactactacattgcgcttggacttgaaggttctgcaaataaactgggcgttggtatagttaagcatccgcttctgcctaaacatgccaacagcgatctatcttatgattgcgaagctgagatgctttctaatattagagacacatatgtcacacctcctggggagggatttttgcctcgagacacggcaaggcatcacagaaattggtgcataagactcataaaacaagcactggccgaagctgacatcaaaagcccgacactagacattgatgtaatttgctttaccaaaggtcccggcatgggggcccctctgcattcagttgtcatcgccgccagaacgtgctccttactgtgggacgtgccactggtgggagtaaaccactgcattggtcacatcgaaatggggagagaaatcactaaagctcaaaatcctgtggtactgtatgtaagtggtggaaatacacaagttattgcatactcggaaaaaaggtaccgtatctttggtgaaacgcttgatattgctatcggtaattgtcttgatagatttgcaagaactctgaagatacctaatgagccctcgcctggctacaacatcgagcagttagctaaaaaagcccctcacaaagaaaacttggtagaacttccctatacagtaaaggggatggatctttcgatgagtggtatattggcttccatcgatttacttgccaaggatctatttaagggcaataagaaaaataagatcctattcgacaagacaacgggcgagcaaaaagtcactgtagaggatctttgctactctctgcaagagaacctattcgccatgctagttgaaataacagaaagagctatggctcacgttaactccaatcaagttttgatcgtaggcggtgttggttgtaacgtgcgattacaagaaatgatggcgcaaatgtgtaaagacagggccaatgggcaagtacatgctacagataataggttttgtatcgataacggagttatgattgcccaagcaggactactagagtatagaatgggtgggatcgtgaaggacttttctgaaactgttgttacgcagaaattcagaaccgatgaagtatacgcagcctggcgtgattaa

SEQ ID NO: 163 - DNA, 1026 bp, Saccharomyces cerevisiae
atgagtttagaggctacagattccaaggccatggttttgttgatgggcgtaagaagatgtggaaaatcatccatttgtaaagttgtttttcataatatgcagcctttagatacattatatctagaatcaacctcaaatccttctcttgagcatttctctactctcattgacctggcggtgatggagcttcccgggcagctaaattactttgaaccgagttatgattctgaaagattattcaaaagcgttggggcactagtttatgtcattgattctcaagatgaatatatcaatgcgatcacaaatctggcgatgattattgagtatgcctataaggttaatccctccatcaatatagaggtcttgattcacaaggttgatggcctaagtgaagatttcaaagttgatgctcaacgtgatataatgcaacggacaggtgaagagttgcttgaactggggctggatggtgttcaggtttccttctatttaacttcaatttttgatcactcaatatatgaggcattttcgaggattgtgcagaaactgataccggagctgtcttttctggagaatatgctagataatttaattcaacattcaaaaattgagaaggccttcttatttgatgttaattccaaaatttatgtttccacagattctaaccctgttgatatacaaatgtatgaggtatgctccgagttcatagatgtgacgattgatttgtttgatttatataaagcgcctgttctaagaaatagccaaaagagctcggacaaagataatgtgataaatcctcgtaatgagctacagaatgtatcacaattagctaatggcgtcattatttatttgaggcagatgattagaggcttggcattggtggcgattataagacctaatggtacagacatggaaagctgcttaacggtcgcagattacaatattgacattttcaagaaggggttggaagatatttgggcaaacgcaagagccagtcaagctaaaaatagtattgaggacgatgtgtga

SEQ ID NO: 164 - DNA, 1392 bp, Saccharomyces cerevisiae
atgtcgaagaaatttagctctaaaaactcccaaaggtacgtggtggtacacagaccccatgatgatccttcattttatgatacagatgcctctgcgcacgttttggttcctgtctccaatccaaataaaacttctccagaagcagatcttcgaaaaaaagacgtgagttcaacaaaaccaaagggtaggagggctcatgtgggagaagcagctttatatggtattaattttgatgattctgaatacgattatactcaacatttgaagccaataggtctcgaccctgaaaactccatctttatagcatccaaaggcaatgaacagaaggtcgaaaaaaaaaacattgaagatttattcatcgaacctaagtatagacgtgatgaaattgagaaggatgacgcgctacctgtgtttcaaagagggatggcaaagccagaatatttactacaccaacaagataccaccgatgaaattagaggtttcaaacctgatatgaatcctgcattaagagaggtgcttgaagctttagaagatgaagcatatgttgttaatgatgatgttgtggttgaagacatcagcaaaaagacacaacttcaaggcgataactatggagaagaagaaaaggaagatgacattttcgcacaattactagggagcggtgaagcaaaagatgaagacgaattcgaggatgagtttgatgagtgggatattgataatgtagaaaattttgaagatgaaaactacgttaaggaaatggcgcaatttgataacatcgaaaacctggaggacttggaaaatatcgattatcaagctgatgttcgaagatttcaaaaagataactctatactagaaaagcataactcggatgatgaattttctaatgcaggtttagacagtgtaaatccctctgaagaggaagatgtgctgggcgaattgccctctatccaagacaaaagcaagacggggaagaagaaaagaaagagccgtcaaaaaaagggtgccatgtcagatgtatctggattttccatgagttcaagtgccattgcgcgtacagagacgatgacagtactggatgatcagtacgatcaaatcatcaatggttacgaaaattatgaggaagaactagaagaggacgaagaacaaaattaccaaccatttgacatgtcagcagaaagatctgattttgagtcaatgcttgatgactttttggacaattacgaactggagagtggtggccgtaaactggctaagaaagataaagaaattgaaaggctgaaggaagctgctgatgaagtaagcaaaggtaaactgtctcagagaagaaatcgtgaaaggcaagagaaaaagaaacttgagaaggtcaccaatacactaagcagcttaaaattttag

SEQ ID NO: 165 - DNA, 555 bp, Saccharomyces cerevisiae
atgggagccgtactcagctgttgtagaaaccattccggcgaagagaatgaagctttgctgagggaacagcaggcaggctatggaagtcaaggaaacgcaaatgacgaatacgatgccgaacaaatgcggttgaaggaacacgaacacgaacagaaactgctggccagggaacaagagttaagagacattgttgcaaacaccaacgataaactaatagacatatcgatgataaacaatagtggcattgtaattcaagggacagacctgcaagaagctcttgataaaagacaacaggaagaaggtggagattcccgggaagacgaaaggagtgcaggtgatgacaacctcagtgggcactcagtgccttcaagcggatccgcacaggcaactactcaccaaactgcaccaaggactaatacgtttactctgcttacatcaccggattcagcgaaaatatcaaaggaacagttaaagaagttgcactctaatatactaaatgaaattttcagccagtcccaggtaaacaaaccaggccccttgacggttcccttttaa

SEQ ID NO: 166 - DNA, 933 bp, Saccharomyces cerevisiae
atgtcgtcaaataataggaagaaactgcttctgatgggccggtccggctccggtaaatcgtcaatgaggtcgatcatctttagtaactactccgcttttgacactaggagattgggtgccaccattgatgtagagcactcccatttgagatttcttgggaatatgactctaaatctgtgggactgtggtgggcaggacgtgtttatggagaattatttcaccaagcaaaaagaccacattttccagatggtgcaggtgttaattcacgtttttgatgtagagtcaactgaagttctcaaggatattgaaatatttgcaaaagctttgaagcaattaaggaagtactctcccgacgccaaaatttttgttcttctgcataagatggatcttgttcagttggataagagagaggagctgttccaaatcatgatgaaaaacctgagtgaaacgtcttcggaatttgggtttcccaatctgataggttttcctacttcgatttgggatgagagtttatacaaggcatggtcgcagattgtatgctcgctaatacccaatatgtccaaccatcaaagtaatttgaagaagtttaaggagattatgaacgcccttgaaattattcttttcgaaagaacaactttcttagtgatatgctccagtaatggcgaaaatagtaatgaaaatcatgatagttcggataataataatgtcttgctagacccgaagcgattcgaaaagatatccaatataatgaaaaacttcaagcagagttgcacgaaattgaagagcggattcaagactttaatattgaacaacaacatctacgtcagcgagttatcgtccaatatggtgtgttttatagtgttgaaagatatgaatattccacaagaattagtattggaaaacatcaaaaaagccaaagagtttttccaatga

SEQ ID NO: 167 - DNA, 2289 bp, Saccharomyces cerevisiae
atgacgcaagaattcattgataaagtatcttcctacctgactcctgatgtggacattgcacctatttctcaaggtgcagaagccattgttttcacaacgactactcacccatatctcccaagagcaaaggattctcatcaaaagtatattatcaaatataggccaccaaagcgttatagacatccacaaatagaccaggcactaacaaaacatcgtacgttgaatgagtcgcgtttattggccaaattatacttgattccagggctatgtgtccctcaactgatagcgtgtgatccatacaatggattcatttggttagagttccttggagaagatcttcccggagggcacggttttagtaacctaaagaacttcctttggatgcatgaccaagatccatatagtgatcttgtagcaactacactacggaaagtggggcgccaaattgggttgttgcactggaatgactactgtcatggtgatttgacaagttctaacattgttctcgtgcgagatggtgcgagatggacgcctcatttgattgatttcggtctgggctcagtttcaaacctggtcgaagataaaggcgtcgatttatacgtcttagagagagctattttaagtacacattcgaagcatgcggaaaaatacaatgcttggatcatggaggggttcgaagaggtctatcgtgaacaaggtgcgaaaggtgccaagaaactgaaagaagttaccaaaagattcgaagaggtcaggttgcgtggtcgtaagagaagtatgctaggaggaagtgcagctcctggtgcatcaggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 168 - DNA, 1875 bp, Saccharomyces cerevisiae
atgaaactaccggtagcacagtacagtgcaccagatggtgtggaaaaaagttttgcaccaatacgcgatgaccctcgatacatgaccacagagggaaggacaactgggcccagtgaccatgtgctaaacgctggccaaatcgatagagacaaaccttcagaaccggaacgcacgaaagatggctcacaactgacatacttaggccagctgcgcacgcagctgacggggctacaggacgatattaacgagtttttgacaggaagaatggaattggcaaaaaataagaagaaagccggcgcagacgagaagcggatccaggaagagattaaccagctattagatggtggtgacggtgacgaagatgctgttggaagtgcagctcctggtgcatcaggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 169 - DNA, 2664 bp, Saccharomyces cerevisiae
atggtcaacttgaacactatcccacccaaaaatggcagggactactacattgcgcttggacttgaaggttctgcaaataaactgggcgttggtatagttaagcatccgcttctgcctaaacatgccaacagcgatctatcttatgattgcgaagctgagatgctttctaatattagagacacatatgtcacacctcctggggagggatttttgcctcgagacacggcaaggcatcacagaaattggtgcataagactcataaaacaagcactggccgaagctgacatcaaaagcccgacactagacattgatgtaatttgctttaccaaaggtcccggcatgggggcccctctgcattcagttgtcatcgccgccagaacgtgctccttactgtgggacgtgccactggtgggagtaaaccactgcattggtcacatcgaaatggggagagaaatcactaaagctcaaaatcctgtggtactgtatgtaagtggtggaaatacacaagttattgcatactcggaaaaaaggtaccgtatctttggtgaaacgcttgatattgctatcggtaattgtcttgatagatttgcaagaactctgaagatacctaatgagccctcgcctggctacaacatcgagcagttagctaaaaaagcccctcacaaagaaaacttggtagaacttccctatacagtaaaggggatggatctttcgatgagtggtatattggcttccatcgatttacttgccaaggatctatttaagggcaataagaaaaataagatcctattcgacaagacaacgggcgagcaaaaagtcactgtagaggatctttgctactctctgcaagagaacctattcgccatgctagttgaaataacagaaagagctatggctcacgttaactccaatcaagttttgatcgtaggcggtgttggttgtaacgtgcgattacaagaaatgatggcgcaaatgtgtaaagacagggccaatgggcaagtacatgctacagataataggttttgtatcgataacggagttatgattgcccaagcaggactactagagtatagaatgggtgggatcgtgaaggacttttctgaaactgttgttacgcagaaattcagaaccgatgaagtatacgcagcctggcgtgatggaagtgcagctcctggtgcatcaggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 170 - DNA, 1845 bp, Saccharomyces cerevisiae
atgacaagcaaacgggaaaagtcactggatcacacattgtaagtagaagcagtttttcaatgggaagaccgcactgcatagtttactaactatttaaactttccaaacattagagaactaaagataccgtttgaaacggagcgacaagcgaccatagcaaccaaagtcctatctccggacccgattttgaagccacaagattttcaagtagactacagttccgagaaaaatgtcatgctagtccagttcagaagcattgatgatagggtgcttcgagtgggagttagcagtatcatagacagtatcaaaaccattgtggaagccatggacgttctatcaggaagtgcagctcctggtgcatcaggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 171 - DNA, 2155 bp, Saccharomyces cerevisiae
atggtagtatccatcataccgcaatttcctgatatcaaggtttcactagcattgtttgaacaggttaaaaatgctaaagaaatacgctctaaaatgagtgaattgtcgacatcctttgcctttattgacccccggttagtctgttcgggggagcagatgtattctgcaatttacaagaccttaatagaagtgaaatataacaagatgagaacaagaaatttgaattccgagtgcgtactatgtctttcacccacttccaatattagtgatgctttcctcaaattcggaatcaaagacgattcgtcacagttaatatgccttaagttccatactaatactgacgatgtagacaaagagcaattgaggacgattatgacttctatagtaaaaggacaagagatcgagtttaatgatgacaatttatcgagattttatgacgaagcgctcataagaaaagtatgttttaataataaattcgaggtaaaaacttcaacagcctcaccagaaacacattgtactaacttcacctttgttttccttttattttgtttttacctattagatctataaattaagtgatgatttcaagccccaagacgtaaatggtctctcaagagctttggtagacgctattcaattgaggggtgtgggaagtgcagctcctggtgcatcaggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 172 - DNA, 1992 bp, Saccharomyces cerevisiae
atggtgatgctccattctaaaaacgttaaagggtttctggaaaacactttgaaaccgtatgatttgcattcggtagacttcaagacatcgtctttgcaatcgtctatgattataaccgccactaatgggggtatactgtcctatgcgacgtcaaacaacgatgtaccgaaaaattccataaacgaaataaactcggtcaataacttgaaaatgatgagcttattgattaaggataagtggtcagaggatgaaaacgatactgaggaacagcactccaatagctgttaccctgtggaaatcgactcctttaagacaaaaatatatacttacgaaatggaagatttacatacctgtgtcgcacagatacccaatagcgaccttttgctattgttcattgcggaaggtagcttcccttacggactactggtaattaaaattgaaagagctatgagagagttgactgatttgtttggctacaagctaggtggaagtgcagctcctggtgcatcaggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 173 - DNA, 2529 bp, Saccharomyces cerevisiae
atgagtttagaggctacagattccaaggccatggttttgttgatgggcgtaagaagatgtggaaaatcatccatttgtaaagttgtttttcataatatgcagcctttagatacattatatctagaatcaacctcaaatccttctcttgagcatttctctactctcattgacctggcggtgatggagcttcccgggcagctaaattactttgaaccgagttatgattctgaaagattattcaaaagcgttggggcactagtttatgtcattgattctcaagatgaatatatcaatgcgatcacaaatctggcgatgattattgagtatgcctataaggttaatccctccatcaatatagaggtcttgattcacaaggttgatggcctaagtgaagatttcaaagttgatgctcaacgtgatataatgcaacggacaggtgaagagttgcttgaactggggctggatggtgttcaggtttccttctatttaacttcaatttttgatcactcaatatatgaggcattttcgaggattgtgcagaaactgataccggagctgtcttttctggagaatatgctagataatttaattcaacattcaaaaattgagaaggccttcttatttgatgttaattccaaaatttatgtttccacagattctaaccctgttgatatacaaatgtatgaggtatgctccgagttcatagatgtgacgattgatttgtttgatttatataaagcgcctgttctaagaaatagccaaaagagctcggacaaagataatgtgataaatcctcgtaatgagctacagaatgtatcacaattagctaatggcgtcattatttatttgaggcagatgattagaggcttggcattggtggcgattataagacctaatggtacagacatggaaagctgcttaacggtcgcagattacaatattgacattttcaagaaggggttggaagatatttgggcaaacgcaagagccagtcaagctaaaaatagtattgaggacgatgtgggaagtgcagctcctggtgcatcaggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 174 - DNA, 2895 bp, Saccharomyces cerevisiae
atgtcgaagaaatttagctctaaaaactcccaaaggtacgtggtggtacacagaccccatgatgatccttcattttatgatacagatgcctctgcgcacgttttggttcctgtctccaatccaaataaaacttctccagaagcagatcttcgaaaaaaagacgtgagttcaacaaaaccaaagggtaggagggctcatgtgggagaagcagctttatatggtattaattttgatgattctgaatacgattatactcaacatttgaagccaataggtctcgaccctgaaaactccatctttatagcatccaaaggcaatgaacagaaggtcgaaaaaaaaaacattgaagatttattcatcgaacctaagtatagacgtgatgaaattgagaaggatgacgcgctacctgtgtttcaaagagggatggcaaagccagaatatttactacaccaacaagataccaccgatgaaattagaggtttcaaacctgatatgaatcctgcattaagagaggtgcttgaagctttagaagatgaagcatatgttgttaatgatgatgttgtggttgaagacatcagcaaaaagacacaacttcaaggcgataactatggagaagaagaaaaggaagatgacattttcgcacaattactagggagcggtgaagcaaaagatgaagacgaattcgaggatgagtttgatgagtgggatattgataatgtagaaaattttgaagatgaaaactacgttaaggaaatggcgcaatttgataacatcgaaaacctggaggacttggaaaatatcgattatcaagctgatgttcgaagatttcaaaaagataactctatactagaaaagcataactcggatgatgaattttctaatgcaggtttagacagtgtaaatccctctgaagaggaagatgtgctgggcgaattgccctctatccaagacaaaagcaagacggggaagaagaaaagaaagagccgtcaaaaaaagggtgccatgtcagatgtatctggattttccatgagttcaagtgccattgcgcgtacagagacgatgacagtactggatgatcagtacgatcaaatcatcaatggttacgaaaattatgaggaagaactagaagaggacgaagaacaaaattaccaaccatttgacatgtcagcagaaagatctgattttgagtcaatgcttgatgactttttggacaattacgaactggagagtggtggccgtaaactggctaagaaagataaagaaattgaaaggctgaaggaagctgctgatgaagtaagcaaaggtaaactgtctcagagaagaaatcgtgaaaggcaagagaaaaagaaacttgagaaggtcaccaatacactaagcagcttaaaatttggaagtgcagctcctggtgcatcaggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 175 - DNA, 2058 bp, Saccharomyces cerevisiae
atgggagccgtactcagctgttgtagaaaccattccggcgaagagaatgaagctttgctgagggaacagcaggcaggctatggaagtcaaggaaacgcaaatgacgaatacgatgccgaacaaatgcggttgaaggaacacgaacacgaacagaaactgctggccagggaacaagagttaagagacattgttgcaaacaccaacgataaactaatagacatatcgatgataaacaatagtggcattgtaattcaagggacagacctgcaagaagctcttgataaaagacaacaggaagaaggtggagattcccgggaagacgaaaggagtgcaggtgatgacaacctcagtgggcactcagtgccttcaagcggatccgcacaggcaactactcaccaaactgcaccaaggactaatacgtttactctgcttacatcaccggattcagcgaaaatatcaaaggaacagttaaagaagttgcactctaatatactaaatgaaattttcagccagtcccaggtaaacaaaccaggccccttgacggttccctttggaagtgcagctcctggtgcatcaggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 176 - DNA, 2436 bp, Saccharomyces cerevisiae
atgtcgtcaaataataggaagaaactgcttctgatgggccggtccggctccggtaaatcgtcaatgaggtcgatcatctttagtaactactccgcttttgacactaggagattgggtgccaccattgatgtagagcactcccatttgagatttcttgggaatatgactctaaatctgtgggactgtggtgggcaggacgtgtttatggagaattatttcaccaagcaaaaagaccacattttccagatggtgcaggtgttaattcacgtttttgatgtagagtcaactgaagttctcaaggatattgaaatatttgcaaaagctttgaagcaattaaggaagtactctcccgacgccaaaatttttgttcttctgcataagatggatcttgttcagttggataagagagaggagctgttccaaatcatgatgaaaaacctgagtgaaacgtcttcggaatttgggtttcccaatctgataggttttcctacttcgatttgggatgagagtttatacaaggcatggtcgcagattgtatgctcgctaatacccaatatgtccaaccatcaaagtaatttgaagaagtttaaggagattatgaacgcccttgaaattattcttttcgaaagaacaactttcttagtgatatgctccagtaatggcgaaaatagtaatgaaaatcatgatagttcggataataataatgtcttgctagacccgaagcgattcgaaaagatatccaatataatgaaaaacttcaagcagagttgcacgaaattgaagagcggattcaagactttaatattgaacaacaacatctacgtcagcgagttatcgtccaatatggtgtgttttatagtgttgaaagatatgaatattccacaagaattagtattggaaaacatcaaaaaagccaaagagtttttccaaggaagtgcagctcctggtgcatcaggttctggaagtggttcaggaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtga

SEQ ID NO: 177 - DNA, 2289 bp, Saccharomyces cerevisiae
atggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagggaagtgcagctcctggtgcatcaggttctggaagtggttcaggaatgacgcaagaattcattgataaagtatcttcctacctgactcctgatgtggacattgcacctatttctcaaggtgcagaagccattgttttcacaacgactactcacccatatctcccaagagcaaaggattctcatcaaaagtatattatcaaatataggccaccaaagcgttatagacatccacaaatagaccaggcactaacaaaacatcgtacgttgaatgagtcgcgtttattggccaaattatacttgattccagggctatgtgtccctcaactgatagcgtgtgatccatacaatggattcatttggttagagttccttggagaagatcttcccggagggcacggttttagtaacctaaagaacttcctttggatgcatgaccaagatccatatagtgatcttgtagcaactacactacggaaagtggggcgccaaattgggttgttgcactggaatgactactgtcatggtgatttgacaagttctaacattgttctcgtgcgagatggtgcgagatggacgcctcatttgattgatttcggtctgggctcagtttcaaacctggtcgaagataaaggcgtcgatttatacgtcttagagagagctattttaagtacacattcgaagcatgcggaaaaatacaatgcttggatcatggaggggttcgaagaggtctatcgtgaacaaggtgcgaaaggtgccaagaaactgaaagaagttaccaaaagattcgaagaggtcaggttgcgtggtcgtaagagaagtatgctaggataa

SEQ ID NO: 178 - DNA, 1875 bp, Saccharomyces cerevisiae
atggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagggaagtgcagctcctggtgcatcaggttctggaagtggttcaggaatgaaactaccggtagcacagtacagtgcaccagatggtgtggaaaaaagttttgcaccaatacgcgatgaccctcgatacatgaccacagagggaaggacaactgggcccagtgaccatgtgctaaacgctggccaaatcgatagagacaaaccttcagaaccggaacgcacgaaagatggctcacaactgacatacttaggccagctgcgcacgcagctgacggggctacaggacgatattaacgagtttttgacaggaagaatggaattggcaaaaaataagaagaaagccggcgcagacgagaagcggatccaggaagagattaaccagctattagatggtggtgacggtgacgaagatgctgtttag

SEQ ID NO: 179 - DNA, 2664 bp, Saccharomyces cerevisiae
atggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagggaagtgcagctcctggtgcatcaggttctggaagtggttcaggaatggtcaacttgaacactatcccacccaaaaatggcagggactactacattgcgcttggacttgaaggttctgcaaataaactgggcgttggtatagttaagcatccgcttctgcctaaacatgccaacagcgatctatcttatgattgcgaagctgagatgctttctaatattagagacacatatgtcacacctcctggggagggatttttgcctcgagacacggcaaggcatcacagaaattggtgcataagactcataaaacaagcactggccgaagctgacatcaaaagcccgacactagacattgatgtaatttgctttaccaaaggtcccggcatgggggcccctctgcattcagttgtcatcgccgccagaacgtgctccttactgtgggacgtgccactggtgggagtaaaccactgcattggtcacatcgaaatggggagagaaatcactaaagctcaaaatcctgtggtactgtatgtaagtggtggaaatacacaagttattgcatactcggaaaaaaggtaccgtatctttggtgaaacgcttgatattgctatcggtaattgtcttgatagatttgcaagaactctgaagatacctaatgagccctcgcctggctacaacatcgagcagttagctaaaaaagcccctcacaaagaaaacttggtagaacttccctatacagtaaaggggatggatctttcgatgagtggtatattggcttccatcgatttacttgccaaggatctatttaagggcaataagaaaaataagatcctattcgacaagacaacgggcgagcaaaaagtcactgtagaggatctttgctactctctgcaagagaacctattcgccatgctagttgaaataacagaaagagctatggctcacgttaactccaatcaagttttgatcgtaggcggtgttggttgtaacgtgcgattacaagaaatgatggcgcaaatgtgtaaagacagggccaatgggcaagtacatgctacagataataggttttgtatcgataacggagttatgattgcccaagcaggactactagagtatagaatgggtgggatcgtgaaggacttttctgaaactgttgttacgcagaaattcagaaccgatgaagtatacgcagcctggcgtgattaa

SEQ ID NO: 180 - DNA, 1845 bp, Saccharomyces cerevisiae
atggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagggaagtgcagctcctggtgcatcaggttctggaagtggttcaggaatgacaagcaaacgggaaaagtcactggatcacacattgtaagtagaagcagtttttcaatgggaagaccgcactgcatagtttactaactatttaaactttccaaacattagagaactaaagataccgtttgaaacggagcgacaagcgaccatagcaaccaaagtcctatctccggacccgattttgaagccacaagattttcaagtagactacagttccgagaaaaatgtcatgctagtccagttcagaagcattgatgatagggtgcttcgagtgggagttagcagtatcatagacagtatcaaaaccattgtggaagccatggacgttctatcataa

SEQ ID NO: 181 - DNA, 2155 bp, Saccharomyces cerevisiae
atggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagggaagtgcagctcctggtgcatcaggttctggaagtggttcaggaatggtagtatccatcataccgcaatttcctgatatcaaggtttcactagcattgtttgaacaggttaaaaatgctaaagaaatacgctctaaaatgagtgaattgtcgacatcctttgcctttattgacccccggttagtctgttcgggggagcagatgtattctgcaatttacaagaccttaatagaagtgaaatataacaagatgagaacaagaaatttgaattccgagtgcgtactatgtctttcacccacttccaatattagtgatgctttcctcaaattcggaatcaaagacgattcgtcacagttaatatgccttaagttccatactaatactgacgatgtagacaaagagcaattgaggacgattatgacttctatagtaaaaggacaagagatcgagtttaatgatgacaatttatcgagattttatgacgaagcgctcataagaaaagtatgttttaataataaattcgaggtaaaaacttcaacagcctcaccagaaacacattgtactaacttcacctttgttttccttttattttgtttttacctattagatctataaattaagtgatgatttcaagccccaagacgtaaatggtctctcaagagctttggtagacgctattcaattgaggggtgtgtag

SEQ ID NO: 182 - DNA, 1992 bp, Saccharomyces cerevisiae
atggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagggaagtgcagctcctggtgcatcaggttctggaagtggttcaggaatggtgatgctccattctaaaaacgttaaagggtttctggaaaacactttgaaaccgtatgatttgcattcggtagacttcaagacatcgtctttgcaatcgtctatgattataaccgccactaatgggggtatactgtcctatgcgacgtcaaacaacgatgtaccgaaaaattccataaacgaaataaactcggtcaataacttgaaaatgatgagcttattgattaaggataagtggtcagaggatgaaaacgatactgaggaacagcactccaatagctgttaccctgtggaaatcgactcctttaagacaaaaatatatacttacgaaatggaagatttacatacctgtgtcgcacagatacccaatagcgaccttttgctattgttcattgcggaaggtagcttcccttacggactactggtaattaaaattgaaagagctatgagagagttgactgatttgtttggctacaagctaggttga

SEQ ID NO: 183 - DNA, 2529 bp, Saccharomyces cerevisiae
atggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagggaagtgcagctcctggtgcatcaggttctggaagtggttcaggaatgagtttagaggctacagattccaaggccatggttttgttgatgggcgtaagaagatgtggaaaatcatccatttgtaaagttgtttttcataatatgcagcctttagatacattatatctagaatcaacctcaaatccttctcttgagcatttctctactctcattgacctggcggtgatggagcttcccgggcagctaaattactttgaaccgagttatgattctgaaagattattcaaaagcgttggggcactagtttatgtcattgattctcaagatgaatatatcaatgcgatcacaaatctggcgatgattattgagtatgcctataaggttaatccctccatcaatatagaggtcttgattcacaaggttgatggcctaagtgaagatttcaaagttgatgctcaacgtgatataatgcaacggacaggtgaagagttgcttgaactggggctggatggtgttcaggtttccttctatttaacttcaatttttgatcactcaatatatgaggcattttcgaggattgtgcagaaactgataccggagctgtcttttctggagaatatgctagataatttaattcaacattcaaaaattgagaaggccttcttatttgatgttaattccaaaatttatgtttccacagattctaaccctgttgatatacaaatgtatgaggtatgctccgagttcatagatgtgacgattgatttgtttgatttatataaagcgcctgttctaagaaatagccaaaagagctcggacaaagataatgtgataaatcctcgtaatgagctacagaatgtatcacaattagctaatggcgtcattatttatttgaggcagatgattagaggcttggcattggtggcgattataagacctaatggtacagacatggaaagctgcttaacggtcgcagattacaatattgacattttcaagaaggggttggaagatatttgggcaaacgcaagagccagtcaagctaaaaatagtattgaggacgatgtgtga

SEQ ID NO: 184 - DNA, 2895 bp, Saccharomyces cerevisiae
atggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagggaagtgcagctcctggtgcatcaggttctggaagtggttcaggaatgtcgaagaaatttagctctaaaaactcccaaaggtacgtggtggtacacagaccccatgatgatccttcattttatgatacagatgcctctgcgcacgttttggttcctgtctccaatccaaataaaacttctccagaagcagatcttcgaaaaaaagacgtgagttcaacaaaaccaaagggtaggagggctcatgtgggagaagcagctttatatggtattaattttgatgattctgaatacgattatactcaacatttgaagccaataggtctcgaccctgaaaactccatctttatagcatccaaaggcaatgaacagaaggtcgaaaaaaaaaacattgaagatttattcatcgaacctaagtatagacgtgatgaaattgagaaggatgacgcgctacctgtgtttcaaagagggatggcaaagccagaatatttactacaccaacaagataccaccgatgaaattagaggtttcaaacctgatatgaatcctgcattaagagaggtgcttgaagctttagaagatgaagcatatgttgttaatgatgatgttgtggttgaagacatcagcaaaaagacacaacttcaaggcgataactatggagaagaagaaaaggaagatgacattttcgcacaattactagggagcggtgaagcaaaagatgaagacgaattcgaggatgagtttgatgagtgggatattgataatgtagaaaattttgaagatgaaaactacgttaaggaaatggcgcaatttgataacatcgaaaacctggaggacttggaaaatatcgattatcaagctgatgttcgaagatttcaaaaagataactctatactagaaaagcataactcggatgatgaattttctaatgcaggtttagacagtgtaaatccctctgaagaggaagatgtgctgggcgaattgccctctatccaagacaaaagcaagacggggaagaagaaaagaaagagccgtcaaaaaaagggtgccatgtcagatgtatctggattttccatgagttcaagtgccattgcgcgtacagagacgatgacagtactggatgatcagtacgatcaaatcatcaatggttacgaaaattatgaggaagaactagaagaggacgaagaacaaaattaccaaccatttgacatgtcagcagaaagatctgattttgagtcaatgcttgatgactttttggacaattacgaactggagagtggtggccgtaaactggctaagaaagataaagaaattgaaaggctgaaggaagctgctgatgaagtaagcaaaggtaaactgtctcagagaagaaatcgtgaaaggcaagagaaaaagaaacttgagaaggtcaccaatacactaagcagcttaaaattttag

SEQ ID NO: 185 - DNA, 2058 bp, Saccharomyces cerevisiae
atggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagggaagtgcagctcctggtgcatcaggttctggaagtggttcaggaatgggagccgtactcagctgttgtagaaaccattccggcgaagagaatgaagctttgctgagggaacagcaggcaggctatggaagtcaaggaaacgcaaatgacgaatacgatgccgaacaaatgcggttgaaggaacacgaacacgaacagaaactgctggccagggaacaagagttaagagacattgttgcaaacaccaacgataaactaatagacatatcgatgataaacaatagtggcattgtaattcaagggacagacctgcaagaagctcttgataaaagacaacaggaagaaggtggagattcccgggaagacgaaaggagtgcaggtgatgacaacctcagtgggcactcagtgccttcaagcggatccgcacaggcaactactcaccaaactgcaccaaggactaatacgtttactctgcttacatcaccggattcagcgaaaatatcaaaggaacagttaaagaagttgcactctaatatactaaatgaaattttcagccagtcccaggtaaacaaaccaggccccttgacggttcccttttaa

SEQ ID NO: 186 - DNA, 2436 bp, Saccharomyces cerevisiae
atggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagggaagtgcagctcctggtgcatcaggttctggaagtggttcaggaatgtcgtcaaataataggaagaaactgcttctgatgggccggtccggctccggtaaatcgtcaatgaggtcgatcatctttagtaactactccgcttttgacactaggagattgggtgccaccattgatgtagagcactcccatttgagatttcttgggaatatgactctaaatctgtgggactgtggtgggcaggacgtgtttatggagaattatttcaccaagcaaaaagaccacattttccagatggtgcaggtgttaattcacgtttttgatgtagagtcaactgaagttctcaaggatattgaaatatttgcaaaagctttgaagcaattaaggaagtactctcccgacgccaaaatttttgttcttctgcataagatggatcttgttcagttggataagagagaggagctgttccaaatcatgatgaaaaacctgagtgaaacgtcttcggaatttgggtttcccaatctgataggttttcctacttcgatttgggatgagagtttatacaaggcatggtcgcagattgtatgctcgctaatacccaatatgtccaaccatcaaagtaatttgaagaagtttaaggagattatgaacgcccttgaaattattcttttcgaaagaacaactttcttagtgatatgctccagtaatggcgaaaatagtaatgaaaatcatgatagttcggataataataatgtcttgctagacccgaagcgattcgaaaagatatccaatataatgaaaaacttcaagcagagttgcacgaaattgaagagcggattcaagactttaatattgaacaacaacatctacgtcagcgagttatcgtccaatatggtgtgttttatagtgttgaaagatatgaatattccacaagaattagtattggaaaacatcaaaaaagccaaagagtttttccaatga

SEQ ID NO: 187 - protein, 486 aa, Saccharomyces cerevisiae
MDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 188 - protein, 502 aa, Saccharomyces cerevisiae
MLLDVNTNHTLMHDAHVHEHCLIKSIRDDGALHSWSDSSKVFYPKSFYATATNKKNNKLASASMNKTATSNRTVSDEIYFHSTKPQFDGQGSAERTRTLTKRNSFKRTRILKARDDSELLNENRSSLMTPSLSSVMSQVRKTNSAKTLSGECPIHEGHLTQSIKRKFSEEAQSDCSSLSSSKLHPLTDDIADAVDLQTPAIGDEVLAEPVVPKMKIININDLDLFDDWEVKDLVDIFPPVYERRPRSSSALSLVSASSDAKLRPTSVDFQIIDKKGGKTSRRKSRSKSTTENMIYENDLVELEQWPSASPSPETDGSIASSELLPNKRIRQKSLNTNFLKLYSIETSCKRKSILPEVEVDDHLLKQLTYSEIRSLEIKKEPNVSTNDIKLALITRKKLWSDMVHETRNDLFGDSTPWNLHFVATTSNTEPSQGRESASEHATADLKSSLVRVHSDVKPWFNNGGTMLKPCGKLNLGKVTNKTSAPTREIQYVVKGWCDSRFL

SEQ ID NO: 189 - protein, 49 aa, Saccharomyces cerevisiae
MWRRRREPWEELSFLLNSLSPRNWFIRRWGLMAGRGQHLCWLRCACDGP

SEQ ID NO: 190 - protein, 136 aa, Saccharomyces cerevisiae
MSSVESSPISRYEDEVFPLSFSNVAFEPPMLSHSPDRSTYADDFSQSYQQELLTFPLSYPIVDESECTHTKDKTDSNIITSTEDDCMFDMEFNGNAASAVAAASKESNSASGFAFASNDAFANVAQQNYRLWLSSV

SEQ ID NO: 191 - protein, 392 aa, Saccharomyces cerevisiae
MADTPSVAVQAPPGYGKTELFHLPLIALASKGDVKYVSFLFVPYTVLLANCMIRLGRRGCLNVAPVRNFIEEGYDGVTDLYVGIYDDLASTNFTDRIAAWENIVECTFRTNNVKLGYLIVDEFHNFETEVYRQSQFGGITNLDFDAFEKAIFLSGTAPEAVADAALQRIGLTGLAKKSMDINELKRSEDLSRGLSSYPTRMFNLIKEKSEVPLGHVHKIWKKVESQPEEALKLLLALFEIEPESKAIVVASTTNEVEELACSWRKYFRVVWIHGKLGAAEKVSRTKEFVTDGSMQVLIGTKLVTEGIDIKQLMMVIMLDNRLNIIELIQGVGRLRDGGLCYLLSRKNSWAARNRKGELPPIKEGCITEQVREFYGLESKKGKKGQHVGCCVC

SEQ ID NO: 192 - protein, 148 aa, Saccharomyces cerevisiae
MDSYSITNVKYLDPTELHRWMQEGHTTTLREPFQVVDVRGSDYMGGHIKDGWHYAYSRLKQDPEYLRELKHRLLEKQADGRGALNVIFHCMLSQQRGPSAAMLLLRSLDTAELSRCRLWVLRGGFSRWQSVYGDDESVTAGYLPDLWR

SEQ ID NO: 193 - protein, 216 aa, Saccharomyces cerevisiae
MSDKVINPQVAWAQRSSTTDPERNYVLITVSIADCDAPELTIKPSYIELKAQSKPHVGDENVHHYQLHIDLYKEIIPEKTMHKVANGQHYFLKLYKKDLESEYWPRLTKEKVKYPYIKTDFDKWVDEDEQDEVEAEGNDAAQGMDFSQMMGGAGGAGGAGGMDFSQMMGGAGGAGSPDMAQLQQLLAQSGGNLDMGDFKENDEEDEEEEIEPEVKA

SEQ ID NO: 194 - protein, 53 aa, Saccharomyces cerevisiae
MVQYAPFLLGKFSDPLLAIMVGCLSYYVYERKMGRPQGHHLHELIKKRWDDRK

SEQ ID NO: 195 - protein, 605 aa, Saccharomyces cerevisiae
MQTSMVSAKVSIWLVCSVICSSLVRATQSVCSSQNTATTDGVRNQFQSNGWCSNNCAGHQFAIVQGFMCWCSDSEPSTQTSVGDCSGTCPGYGYEDCGNADKDLFGYIYLGQTPLSSVQSVETSTESSVYVSSSSITSSSSTSIVDTTTISPTLTSTSTTPLTTASTSTTPSTDITSALPTTTSTKLSTSIPTSTTSSTSTTTSTSSSTSTTVSVTSSTSTTTSTTSSTLISTSTSSSSSSTPTTTSSAPISTSTTSSTSTSTSTTSPTSSSAPTSSSNTTPTSTTFTTTSPSTAPSSTTVTYTSTTASPITSTITSVNLQTSLKYSVITVTSVHTMDTNISEITSRYLTMKKVITQIYSSTLGATPTSAVATTSASVGGRITNNNNSNTTNSNTPTNKSTEKKGYWDSPGKIAATFVVVGVVCLVIICILIYLIHHYRTRPARKAQDFENEYQSKFYQSKYPNEVTTTTLHTPSPSSNSTFSTPRLIYTDEKGQIMSESPSPRQSTYSLTAGSPPNDPSTLASPFHDPILPRRTSTFLHSPIQKQHEKMESNVTLGEDTVLVDQRLDPSKMLNTLANDDATNHSTISLSDNVDYSRRVLRLMNE

SEQ ID NO: 196 - protein, 178 aa, Saccharomyces cerevisiae
MTLWPHPGSYKIKSATLFCSRDKLGCAFLSESSLCMYFLYNSLSIWALGPHTAGPLLLFSILNCTPARSVTLPISPSRASISFTRMPLPTPPIEGLHEHLPISVNDGVMRVVCAPVLDDAAAASQPACPAPMTTTCVLVVGWKLVKEDMVNRLLRTCKGNEVHEDAKVVTRSIVLWGV

SEQ ID NO: 197 - protein, 657 aa, Saccharomyces cerevisiae
MLKSGRLNFLKLNINSRLLYSTNPQLTKKVIGIDLGTTNSAVAYIRDSNDKKSATIIENDEGQRTTPSIVAFDVKSSPQNKDQMKTLVGMAAKRQNAINSENTFFATKRLIGRAFNDKEVQRDMAVMPYKIVKCESNGQAYLSTSNGLIQSPSQIASILLKYLKQTSEEYLGEKVNLAVITVPAYFNDSQRQATKDAGKLAGLNVLRVINEPTAAALSFGIDDKRNNGLIAVYDLGGGTFDISILDIEDGVFEVRATNGDTHLGGEDFDNVIVNYIIDTFIHENPEITREEITKNRETMQRLKDVSERAKIDLSHVKKTFIELPFVYKSKHLRVPMTEEELDNMTLSLINRTIPPVKQALKDADIEPEDIDEVILVGGMTRMPKIRSVVKDLFGKSPNSSVNPDETVALGAAIQGGILSGEIKNVLLLDVTPLTLGIETFGGAFSPLIPRNTTVPVKKTEIFSTGVDGQAGVDIKVFQGERGLVRNNKLIGDLKLTGITPLPKGIPQIYVTFDIDADGIINVSAAEKSSGKQQSITVIPNSGLSEEEIAKLIEEANANRAQDNLIRQRLELISKADIMISDTENLFKRYEKLISSEKEYSNIVEDIKALRQAIKNFKANENDMSIDVNGIKKATDALQGRALKLFQSATKNQQNQGK

SEQ ID NO: 198 - protein, 542 aa, Saccharomyces cerevisiae
MGNQSLVVLTESKGEYENETELPVKKSSRDNNIGESLTATAFTQSEDEMVDSNQKWQNPNYFKYAWQEYLFIFTCMISQLLNQAGTTQTLSIMNILSDSFGSEGNSKSWLMASFPLVSGSFILISGRLGDIYGLKKMLLVGYVLVIIWSLICGITKYSGSDTFFIISRAFQGLGIAFVLPNVLGIIGNIYVGGTFRKNIVISFVGAMAPIGATLGCLFAGLIGTEDPKQWPWAFYAYSIAAFINFVLSIYAIPSTIPTNIHHFSMDWIGSVLGVIGLILLNFVWNQAPISGWNQAYIIVILIISVIFLVVFIIYEIRFAKTPLLPRAVIKDRHMIQIMLALFFGWGSFGIFTFYYFQFQLNIRQYTALWAGGTYFMFLIWGIIAALLVGFTIKNVSPSVFLFFSMVAFNVGSIMASVTPVHETYFRTQLGTMIILSFGMDLSFPASSIIFSDNLPMEYQGMAGSLVNTVVNYSMSLCLGMGATVETQVNSDGKHLLKGYRGAQYLGIGLASLACMISGLYMVESFIKGRRARAAAEYDCTVA

SEQ ID NO: 199 - protein, 167 aa, Saccharomyces cerevisiae
MNNETSGKETASAPLCSPKLPVEKVQRIAKNDPEYMDTSDDAFVATAFATEFFVQVLTHESLHRQQQQQQQQVPPLPDELTLSYDDISAAIVHSSDGHLQFLNDVIPTTKNLRLLVEENRVRYTTSVMPPNEVYSAYVVNDTAPKPNIVEIDLDNDEDDDEDVTDQE

SEQ ID NO: 200 - protein, 293 aa, Saccharomyces cerevisiae
MASVNNYQVDCGSRSARIQPRINNGIHDEESLFEVLELSEEEFELDFHRLKSFNDVRVINNPDLSPECTNTAISRDETLESASSAFEVPSDEIAILSISSDSNKNSPPSEQPAPALRNIRSSSNSDRIDEWCLGSHLFNELHQNVPQSSDGVNHGFPVYSFKERELYTSAKLKKLTNAQRIAVQKLSRDLYPILRTCYREKTRRQLLTYHHERIFDDIPSFFPQRDFIFNYYSMPLEFDRLSDVDIDSSSRSRFTDESTGETLNRSPSAASSSLENTSWFGWTLLSRFLDREW

SEQ ID NO: 201 - protein, 66 aa, Saccharomyces cerevisiae
MRRLYRHLASFFLLPSCPGNTIQSITSYPANALLRSFRHVSTETPVRNRVHNRDSQSCPFFPLMDD

SEQ ID NO: 202 - protein, 533 aa, Saccharomyces cerevisiae
MERLKQLEEKRRQLKELRERRKQASLFPGSETMGHHPTEVHAKATMVSVSVQTDMEEGSKIQEPQSAYLRRKEVITYDKGIQTDQIEEEQLQENENHTTTDAVAIETTAADENNKDKAENDQPRLELAKPFLVEEAAATLSNASFARLETEVSASGQQAPSNMQQDKDNLMQWNMVSENLQSETDCDCIAQEYDPGKGVLVVVYLRLPPADLQYASSEAAWSVVNVVKCDNASGRNGLLIDMVEFRGTRIMTATILRRYHPESNVISILLATLTGKIILYELRLKQKKPETPVVYVVQRNMVARHYFQHPVVAVIETSSVQDQERVLVAADNGNIMELSCLDLTVLRKPQQLRPVPLSQLLSLENDTCTYTERLQRLAKFDEVGIACMAYTSEDPQYVWIGGEDGGIYKVFWDQPGPLYLSLDNNGFQPAENHSTRVTGLEFHWDDARRLMLLLSCSTDWTVRLWDARAGKAIIGAPLLLGGPVLRARWLEKNNGGENSRTLRCQVWCADGRLVVVNWAFDAKTSLYTATVIS

SEQ ID NO: 203 - protein, 181 aa, Saccharomyces cerevisiae
MVVSIIPQFPDIKVSLALFEQVKNAKEIRSKMSELSTSFAFIDPRLVCSGEQMYSAIYKTLIEVKYNKMRTRNLNSECVLCLSPTSNISDAFLKFGIKDDSSQLICLKFHTNTDDVDKEQLRTIMTSIVKGQEIEFNDDNLSRFYDEALIRKIYKLSDDFKPQDVNGLSRALVDAIQLRGV

SEQ ID NO: 204 - protein, 38 aa, Saccharomyces cerevisiae
MSLRPCLTPSSMQYSDIYIPTHSLTSTSTLAVIPYPAF

SEQ ID NO: 205 - protein, 647 aa, Saccharomyces cerevisiae
MEAGRSADEVLYHNQSSVKLGELERYVITYELYQGDSIPADITLDSLWVKIKNTTKLSYKPAYLLGPFILYCDVRAKDYESSYKIICSADKPVFQSNLQAQQKFIAELSLHHIKPRYVWIVDIVSQILFNKETKVTFEIVVGNSKASLKRKIRCNDSLPDKACNILHTGLSVHRLTTADIWKVPRPIDMSQKSHLVILTHGFQSNVSADMEYLMEEIYKAQMNNPNERLVIKGYMKNACETEKGIKFLGVGLANYIIDELYDDSVGKISFIGHSLGGLTQTFAICYIKTKYPYFFKKVEPINFISLASPLLGIATSTPNYVKMSLSMGIIGTTGQELGLKDGNYGDKPLLYLLSEESLISVLARFKRRTLYANAVNDGIVPLYSSSLLFLDYSQLLQKLGGQTTAPCDPLFQPEVSPIGELPNHSDVANDDDGINASSWNTFWKSKENNCDKKSKRLMNASVIKSMKSVLLSPCPDAKFFSDPDARVATIIHDKIYTEKNLPPPSPTLYEGTAAKEGETRKTRKEMEEIIARRWHKGMHWRKVVVLLKPDAHNNIIVRRRFSNAYGWPVVDHLVTAHFQRDDPIASPMQDKQFAEEDINMATGGVEPNKFYSWLTKIEDPSVYHGGIVSTASQLASSWISKHSSVTD

SEQ ID NO: 206 - protein, 104 aa, Saccharomyces cerevisiae
MVTQLKSASEYDSALASGDKLVVVDFFATWCGPCKMIAPMIEKFAEQYSDAAFYKLDVDEVSDVAQKAEVSSMPTLIFYKGGKEVTRVVGANPAAIKQAIASNV

SEQ ID NO: 207 - protein, 162 aa, Saccharomyces cerevisiae
MVMLHSKNVKGFLENTLKPYDLHSVDFKTSSLQSSMIITATNGGILSYATSNNDVPKNSINEINSVNNLKMMSLLIKDKWSEDENDTEEQHSNSCYPVEIDSFKTKIYTYEMEDLHTCVAQIPNSDLLLLFIAEGSFPYGLLVIKIERAMRELTDLFGYKLG

SEQ ID NO: 208 - protein, 102 aa, Saccharomyces cerevisiae
MAGDSISADGTGVHPVELSVYSVLSTDLDGLYQSINELRESQALLILMLRKVRDKLRREGQVLYDPEPFKPTMDKLADLSARVRILSQRYEELQGNARALNN

SEQ ID NO: 209 - protein, 458 aa, Saccharomyces cerevisiae
MGKEKSHINVVVIGHVDSGKSTTTGHLIYKCGGIDKRTIEKFEKEAAELGKGSFKYAWVLDKLKAERERGITIDIALWKFETPKYQVTVIDAPGHRDFIKNMITGTSQADCAILIIAGGVGEFEAGISKDGQTREHALLAFTLGVRQLIVAVNKMDSVKWDESRFQEIVKETSNFIKKVGYNPKTVPFVPISGWNGDNMIEATTNAPWYKGWEKETKAGVVKGKTLLEAIDAIEQPSRPTDKPLRLPLQDVYKIGGIGTVPVGRVETGVIKPGMVVTFAPAGVTTEVKSVEMHHEQLEQGVPGDNVGFNVKNVSVKEIRRGNVCGDAKNDPPKGCASFNATVIVLNHPGQISAGYSPVLDCHTAHIACRFDELLEKNDRRSGKKLEDHPKFLKSGDAALVKFVPSKPMCVEAFSEYPPLGRFAVRDMRQTVAVGVIKSVDKTEKAAKVTKAAQKAAKK

SEQ ID NO: 210 - protein, 88 aa, Saccharomyces cerevisiae
MTSKREKSLDHTLELKIPFETERQATIATKVLSPDPILKPQDFQVDYSSEKNVMLVQFRSIDDRVLRVGVSSIIDSIKTIVEAMDVLS

SEQ ID NO: 211 - protein, 144 aa, Saccharomyces cerevisiae
MGKKAHGGKMKPEIDENGTLLVPPPRTIANQDHFHRLNYLYQISAYQTRARQKARTDAHTPLARNYIKSMDLISKKTKTSLLPTIKRTICKKCHRLLWTPKKLEITSDGALSVMCGCGTVKRFNIGADPNYRTYSEREGNLLNS

SEQ ID NO: 212 - protein, 123 aa, Saccharomyces cerevisiae
MKLPVAQYSAPDGVEKSFAPIRDDPRYMTTEGRTTGPSDHVLNAGQIDRDKPSEPERTKDGSQLTYLGQLRTQLTGLQDDINEFLTGRMELAKNKKKAGADEKRIQEEINQLLDGGDGDEDAV

SEQ ID NO: 213 - protein, 157 aa, Saccharomyces cerevisiae
MSDEEHTFETADAGSSATYPMQCSALRKNGFVVIKSRPCKIVDMSTSKTGKHGHAKVHLVAIDIFTGKKLEDLSPSTHNMEVPVVKRNEYQLLDIDDGFLSLMNMDGDTKDDVKAPEGELGDSLQTAFDEGKDLMVTIISAMGEEAAISFKEAARTD

SEQ ID NO: 214 - protein, 210 aa, Saccharomyces cerevisiae
MMSQVSHSQEGSGRFWNKFKSSTKSLSTSLAHLSIKAEKDGDTVNTTLVHKGLVKFYENQHPFQGFPGWLGEKEDLPNERKILDTQVKHDMKKQNSRHFSPSFSNRRKASSEDPMGTPSSNGNTPEYTPASKSFQDIYNNHTSSSSATPRRASSRPTRPSAGQEFRASLGRSKTSNSFNTSSTPTPPPDASSGVMAMKDRLKRRNNDYGF

SEQ ID NO: 215 - protein, 238 aa, Saccharomyces cerevisiae
MSHKLTILPFLIKFTPKFPQSIDHDEHGLNVYAFDLDHTIIKPKSPNISFSRSASDWQFINFNSKKSTLDYLCNIIDNDPTAVIVIFSNQGGVITVPRTSKSCTKYTNKILLFLKAIKNDERGETLSHRLWLYAAPKRPKTFAANHSKITFASLGESYNNDPNIFEKVRKPMTGMVEFFKRDLESAYRVSEQISPIKLNWIYYCGDAAGRKKDFSDSDIKFAENLHVEFKYPEEIFHG

SEQ ID NO: 216 - protein, 61 aa, Saccharomyces cerevisiae
MFSELINFQNEGHECQCQCGSCKNNEQCQKSCSCPTGCNSDDKCPCGNKSEETKKSCCSGK

SEQ ID NO: 217 - protein, 158 aa, Saccharomyces cerevisiae
MVTGGMASKWDQKGMDIAYEEAALGYKEGGVPIGGCLINNKDGSVLGRGHNMRFQKGSATLHGEISTLENCGRLEGKVYKDTTLYTTLSPCDMCTGAIIMYGIPRCVVGENVNFKSKGEKYLQTRGHEVVVVDDERCKKIMKQFIDERPQDWFEDIGE

SEQ ID NO: 218 - protein, 261 aa, Saccharomyces cerevisiae
MARGPKKHLKRLAAPHHWLLDKLSGCYAPRPSAGPHKLRESLPLIVFLRNRLKYALNGREVKAILMQRHVKVDGKVRTDTTYPAGFMDVITLDATNENFRLVYDVKGRFAVHRITDEEASYKLGKVKKVQLGKKGVPYVVTHDGRTIRYPDPNIKVNDTVKIDLASGKITDFIKFDAGKLVYVTGGRNLGRIGTIVHKERHDGGFDLVHIKDSLDNTFVTRLNNVFVIGEQGKPYISLPKGKGIKLSIAEERDRRRAQQGL

SEQ ID NO: 219 - protein, 261 aa, Saccharomyces cerevisiae
MTQEFIDKVSSYLTPDVDIAPISQGAEAIVFTTTTHPYLPRAKDSHQKYIIKYRPPKRYRHPQIDQALTKHRTLNESRLLAKLYLIPGLCVPQLIACDPYNGFIWLEFLGEDLPGGHGFSNLKNFLWMHDQDPYSDLVATTLRKVGRQIGLLHWNDYCHGDLTSSNIVLVRDGARWTPHLIDFGLGSVSNLVEDKGVDLYVLERAILSTHSKHAEKYNAWIMEGFEEVYREQGAKGAKKLKEVTKRFEEVRLRGRKRSMLG

SEQ ID NO: 220 - protein, 386 aa, Saccharomyces cerevisiae
MVNLNTIPPKNGRDYYIALGLEGSANKLGVGIVKHPLLPKHANSDLSYDCEAEMLSNIRDTYVTPPGEGFLPRDTARHHRNWCIRLIKQALAEADIKSPTLDIDVICFTKGPGMGAPLHSVVIAARTCSLLWDVPLVGVNHCIGHIEMGREITKAQNPVVLYVSGGNTQVIAYSEKRYRIFGETLDIAIGNCLDRFARTLKIPNEPSPGYNIEQLAKKAPHKENLVELPYTVKGMDLSMSGILASIDLLAKDLFKGNKKNKILFDKTTGEQKVTVEDLCYSLQENLFAMLVEITERAMAHVNSNQVLIVGGVGCNVRLQEMMAQMCKDRANGQVHATDNRFCIDNGVMIAQAGLLEYRMGGIVKDFSETVVTQKFRTDEVYAAWRD

SEQ ID NO: 221 - protein, 341 aa, Saccharomyces cerevisiae
MSLEATDSKAMVLLMGVRRCGKSSICKVVFHNMQPLDTLYLESTSNPSLEHFSTLIDLAVMELPGQLNYFEPSYDSERLFKSVGALVYVIDSQDEYINAITNLAMIIEYAYKVNPSINIEVLIHKVDGLSEDFKVDAQRDIMQRTGEELLELGLDGVQVSFYLTSIFDHSIYEAFSRIVQKLIPELSFLENMLDNLIQHSKIEKAFLFDVNSKIYVSTDSNPVDIQMYEVCSEFIDVTIDLFDLYKAPVLRNSQKSSDKDNVINPRNELQNVSQLANGVIIYLRQMIRGLALVAIIRPNGTDMESCLTVADYNIDIFKKGLEDIWANARASQAKNSIEDDV

SEQ ID NO: 222 - protein, 463 aa, Saccharomyces cerevisiae
MSKKFSSKNSQRYVVVHRPHDDPSFYDTDASAHVLVPVSNPNKTSPEADLRKKDVSSTKPKGRRAHVGEAALYGINFDDSEYDYTQHLKPIGLDPENSIFIASKGNEQKVEKKNIEDLFIEPKYRRDEIEKDDALPVFQRGMAKPEYLLHQQDTTDEIRGFKPDMNPALREVLEALEDEAYVVNDDVVVEDISKKTQLQGDNYGEEEKEDDIFAQLLGSGEAKDEDEFEDEFDEWDIDNVENFEDENYVKEMAQFDNIENLEDLENIDYQADVRRFQKDNSILEKHNSDDEFSNAGLDSVNPSEEEDVLGELPSIQDKSKTGKKKRKSRQKKGAMSDVSGFSMSSSAIARTETMTVLDDQYDQIINGYENYEEELEEDEEQNYQPFDMSAERSDFESMLDDFLDNYELESGGRKLAKKDKEIERLKEAADEVSKGKLSQRRNRERQEKKKLEKVTNTLSSLKF

SEQ ID NO: 223 - protein, 184 aa, Saccharomyces cerevisiae
MGAVLSCCRNHSGEENEALLREQQAGYGSQGNANDEYDAEQMRLKEHEHEQKLLAREQELRDIVANTNDKLIDISMINNSGIVIQGTDLQEALDKRQQEEGGDSREDERSAGDDNLSGHSVPSSGSAQATTHQTAPRTNTFTLLTSPDSAKISKEQLKKLHSNILNEIFSQSQVNKPGPLTVPF

SEQ ID NO: 224 - protein, 310 aa, Saccharomyces cerevisiae
MSSNNRKKLLLMGRSGSGKSSMRSIIFSNYSAFDTRRLGATIDVEHSHLRFLGNMTLNLWDCGGQDVFMENYFTKQKDHIFQMVQVLIHVFDVESTEVLKDIEIFAKALKQLRKYSPDAKIFVLLHKMDLVQLDKREELFQIMMKNLSETSSEFGFPNLIGFPTSIWDESLYKAWSQIVCSLIPNMSNHQSNLKKFKEIMNALEIILFERTTFLVICSSNGENSNENHDSSDNNNVLLDPKRFEKISNIMKNFKQSCTKLKSGFKTLILNNNIYVSELSSNMVCFIVLKDMNIPQELVLENIKKAKEFFQ

SEQ ID NO: 225 - protein, 762 aa, Saccharomyces cerevisiae
MTQEFIDKVSSYLTPDVDIAPISQGAEAIVFTTTTHPYLPRAKDSHQKYIIKYRPPKRYRHPQIDQALTKHRTLNESRLLAKLYLIPGLCVPQLIACDPYNGFIWLEFLGEDLPGGHGFSNLKNFLWMHDQDPYSDLVATTLRKVGRQIGLLHWNDYCHGDLTSSNIVLVRDGARWTPHLIDFGLGSVSNLVEDKGVDLYVLERAILSTHSKHAEKYNAWIMEGFEEVYREQGAKGAKKLKEVTKRFEEVRLRGRKRSMLGGSAAPGASGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 226 - protein, 624 aa, Saccharomyces cerevisiae
MKLPVAQYSAPDGVEKSFAPIRDDPRYMTTEGRTTGPSDHVLNAGQIDRDKPSEPERTKDGSQLTYLGQLRTQLTGLQDDINEFLTGRMELAKNKKKAGADEKRIQEEINQLLDGGDGDEDAVGSAAPGASGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 227 - protein, 887 aa, Saccharomyces cerevisiae
MVNLNTIPPKNGRDYYIALGLEGSANKLGVGIVKHPLLPKHANSDLSYDCEAEMLSNIRDTYVTPPGEGFLPRDTARHHRNWCIRLIKQALAEADIKSPTLDIDVICFTKGPGMGAPLHSVVIAARTCSLLWDVPLVGVNHCIGHIEMGREITKAQNPVVLYVSGGNTQVIAYSEKRYRIFGETLDIAIGNCLDRFARTLKIPNEPSPGYNIEQLAKKAPHKENLVELPYTVKGMDLSMSGILASIDLLAKDLFKGNKKNKILFDKTTGEQKVTVEDLCYSLQENLFAMLVEITERAMAHVNSNQVLIVGGVGCNVRLQEMMAQMCKDRANGQVHATDNRFCIDNGVMIAQAGLLEYRMGGIVKDFSETVVTQKFRTDEVYAAWRDGSAAPGASGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 228 - protein, 589 aa, Saccharomyces cerevisiae
MTSKREKSLDHTLELKIPFETERQATIATKVLSPDPILKPQDFQVDYSSEKNVMLVQFRSIDDRVLRVGVSSIIDSIKTIVEAMDVLSGSAAPGASGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 229 - protein, 682 aa, Saccharomyces cerevisiae
MVVSIIPQFPDIKVSLALFEQVKNAKEIRSKMSELSTSFAFIDPRLVCSGEQMYSAIYKTLIEVKYNKMRTRNLNSECVLCLSPTSNISDAFLKFGIKDDSSQLICLKFHTNTDDVDKEQLRTIMTSIVKGQEIEFNDDNLSRFYDEALIRKIYKLSDDFKPQDVNGLSRALVDAIQLRGVGSAAPGASGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 230 - protein, 663 aa, Saccharomyces cerevisiae
MVMLHSKNVKGFLENTLKPYDLHSVDFKTSSLQSSMIITATNGGILSYATSNNDVPKNSINEINSVNNLKMMSLLIKDKWSEDENDTEEQHSNSCYPVEIDSFKTKIYTYEMEDLHTCVAQIPNSDLLLLFIAEGSFPYGLLVIKIERAMRELTDLFGYKLGGSAAPGASGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 231 - protein, 842 aa, Saccharomyces cerevisiae
MSLEATDSKAMVLLMGVRRCGKSSICKVVFHNMQPLDTLYLESTSNPSLEHFSTLIDLAVMELPGQLNYFEPSYDSERLFKSVGALVYVIDSQDEYINAITNLAMIIEYAYKVNPSINIEVLIHKVDGLSEDFKVDAQRDIMQRTGEELLELGLDGVQVSFYLTSIFDHSIYEAFSRIVQKLIPELSFLENMLDNLIQHSKIEKAFLFDVNSKIYVSTDSNPVDIQMYEVCSEFIDVTIDLFDLYKAPVLRNSQKSSDKDNVINPRNELQNVSQLANGVIIYLRQMIRGLALVAIIRPNGTDMESCLTVADYNIDIFKKGLEDIWANARASQAKNSIEDDVGSAAPGASGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 232 - protein, 964 aa, Saccharomyces cerevisiae
MSKKFSSKNSQRYVVVHRPHDDPSFYDTDASAHVLVPVSNPNKTSPEADLRKKDVSSTKPKGRRAHVGEAALYGINFDDSEYDYTQHLKPIGLDPENSIFIASKGNEQKVEKKNIEDLFIEPKYRRDEIEKDDALPVFQRGMAKPEYLLHQQDTTDEIRGFKPDMNPALREVLEALEDEAYVVNDDVVVEDISKKTQLQGDNYGEEEKEDDIFAQLLGSGEAKDEDEFEDEFDEWDIDNVENFEDENYVKEMAQFDNIENLEDLENIDYQADVRRFQKDNSILEKHNSDDEFSNAGLDSVNPSEEEDVLGELPSIQDKSKTGKKKRKSRQKKGAMSDVSGFSMSSSAIARTETMTVLDDQYDQIINGYENYEEELEEDEEQNYQPFDMSAERSDFESMLDDFLDNYELESGGRKLAKKDKEIERLKEAADEVSKGKLSQRRNRERQEKKKLEKVTNTLSSLKFGSAAPGASGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 233 - protein, 685 aa, Saccharomyces cerevisiae
MGAVLSCCRNHSGEENEALLREQQAGYGSQGNANDEYDAEQMRLKEHEHEQKLLAREQELRDIVANTNDKLIDISMINNSGIVIQGTDLQEALDKRQQEEGGDSREDERSAGDDNLSGHSVPSSGSAQATTHQTAPRTNTFTLLTSPDSAKISKEQLKKLHSNILNEIFSQSQVNKPGPLTVPFGSAAPGASGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 234 - protein, 811 aa, Saccharomyces cerevisiae
MSSNNRKKLLLMGRSGSGKSSMRSIIFSNYSAFDTRRLGATIDVEHSHLRFLGNMTLNLWDCGGQDVFMENYFTKQKDHIFQMVQVLIHVFDVESTEVLKDIEIFAKALKQLRKYSPDAKIFVLLHKMDLVQLDKREELFQIMMKNLSETSSEFGFPNLIGFPTSIWDESLYKAWSQIVCSLIPNMSNHQSNLKKFKEIMNALEIILFERTTFLVICSSNGENSNENHDSSDNNNVLLDPKRFEKISNIMKNFKQSCTKLKSGFKTLILNNNIYVSELSSNMVCFIVLKDMNIPQELVLENIKKAKEFFQGSAAPGASGSGSGSGMDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQ

SEQ ID NO: 235 - protein, 762 aa, Saccharomyces cerevisiae
MDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQGSAAPGASGSGSGSGMTQEFIDKVSSYLTPDVDIAPISQGAEAIVFTTTTHPYLPRAKDSHQKYIIKYRPPKRYRHPQIDQALTKHRTLNESRLLAKLYLIPGLCVPQLIACDPYNGFIWLEFLGEDLPGGHGFSNLKNFLWMHDQDPYSDLVATTLRKVGRQIGLLHWNDYCHGDLTSSNIVLVRDGARWTPHLIDFGLGSVSNLVEDKGVDLYVLERAILSTHSKHAEKYNAWIMEGFEEVYREQGAKGAKKLKEVTKRFEEVRLRGRKRSMLG

SEQ ID NO: 236 - protein, 624 aa, Saccharomyces cerevisiae
MDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQGSAAPGASGSGSGSGMKLPVAQYSAPDGVEKSFAPIRDDPRYMTTEGRTTGPSDHVLNAGQIDRDKPSEPERTKDGSQLTYLGQLRTQLTGLQDDINEFLTGRMELAKNKKKAGADEKRIQEEINQLLDGGDGDEDAV

SEQ ID NO: 237 - protein, 887 aa, Saccharomyces cerevisiae
MDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQGSAAPGASGSGSGSGMVNLNTIPPKNGRDYYIALGLEGSANKLGVGIVKHPLLPKHANSDLSYDCEAEMLSNIRDTYVTPPGEGFLPRDTARHHRNWCIRLIKQALAEADIKSPTLDIDVICFTKGPGMGAPLHSVVIAARTCSLLWDVPLVGVNHCIGHIEMGREITKAQNPVVLYVSGGNTQVIAYSEKRYRIFGETLDIAIGNCLDRFARTLKIPNEPSPGYNIEQLAKKAPHKENLVELPYTVKGMDLSMSGILASIDLLAKDLFKGNKKNKILFDKTTGEQKVTVEDLCYSLQENLFAMLVEITERAMAHVNSNQVLIVGGVGCNVRLQEMMAQMCKDRANGQVHATDNRFCIDNGVMIAQAGLLEYRMGGIVKDFSETVVTQKFRTDEVYAAWRD

SEQ ID NO: 238 - protein, 589 aa, Saccharomyces cerevisiae
MDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQGSAAPGASGSGSGSGMTSKREKSLDHTLELKIPFETERQATIATKVLSPDPILKPQDFQVDYSSEKNVMLVQFRSIDDRVLRVGVSSIIDSIKTIVEAMDVLS

SEQ ID NO: 239 - protein, 682 aa, Saccharomyces cerevisiae
MDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQGSAAPGASGSGSGSGMVVSIIPQFPDIKVSLALFEQVKNAKEIRSKMSELSTSFAFIDPRLVCSGEQMYSAIYKTLIEVKYNKMRTRNLNSECVLCLSPTSNISDAFLKFGIKDDSSQLICLKFHTNTDDVDKEQLRTIMTSIVKGQEIEFNDDNLSRFYDEALIRKIYKLSDDFKPQDVNGLSRALVDAIQLRGV

SEQ ID NO: 240 - protein, 663 aa, Saccharomyces cerevisiae
MDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQGSAAPGASGSGSGSGMVMLHSKNVKGFLENTLKPYDLHSVDFKTSSLQSSMIITATNGGILSYATSNNDVPKNSINEINSVNNLKMMSLLIKDKWSEDENDTEEQHSNSCYPVEIDSFKTKIYTYEMEDLHTCVAQIPNSDLLLLFIAEGSFPYGLLVIKIERAMRELTDLFGYKLG

SEQ ID NO: 241 - protein, 842 aa, Saccharomyces cerevisiae
MDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQGSAAPGASGSGSGSGMSLEATDSKAMVLLMGVRRCGKSSICKVVFHNMQPLDTLYLESTSNPSLEHFSTLIDLAVMELPGQLNYFEPSYDSERLFKSVGALVYVIDSQDEYINAITNLAMIIEYAYKVNPSINIEVLIHKVDGLSEDFKVDAQRDIMQRTGEELLELGLDGVQVSFYLTSIFDHSIYEAFSRIVQKLIPELSFLENMLDNLIQHSKIEKAFLFDVNSKIYVSTDSNPVDIQMYEVCSEFIDVTIDLFDLYKAPVLRNSQKSSDKDNVINPRNELQNVSQLANGVIIYLRQMIRGLALVAIIRPNGTDMESCLTVADYNIDIFKKGLEDIWANARASQAKNSIEDDV

SEQ ID NO: 242 - protein, 964 aa, Saccharomyces cerevisiae
MDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQGSAAPGASGSGSGSGMSKKFSSKNSQRYVVVHRPHDDPSFYDTDASAHVLVPVSNPNKTSPEADLRKKDVSSTKPKGRRAHVGEAALYGINFDDSEYDYTQHLKPIGLDPENSIFIASKGNEQKVEKKNIEDLFIEPKYRRDEIEKDDALPVFQRGMAKPEYLLHQQDTTDEIRGFKPDMNPALREVLEALEDEAYVVNDDVVVEDISKKTQLQGDNYGEEEKEDDIFAQLLGSGEAKDEDEFEDEFDEWDIDNVENFEDENYVKEMAQFDNIENLEDLENIDYQADVRRFQKDNSILEKHNSDDEFSNAGLDSVNPSEEEDVLGELPSIQDKSKTGKKKRKSRQKKGAMSDVSGFSMSSSAIARTETMTVLDDQYDQIINGYENYEEELEEDEEQNYQPFDMSAERSDFESMLDDFLDNYELESGGRKLAKKDKEIERLKEAADEVSKGKLSQRRNRERQEKKKLEKVTNTLSSLKF

SEQ ID NO: 243 - protein, 685 aa, Saccharomyces cerevisiae
MDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQGSAAPGASGSGSGSGMGAVLSCCRNHSGEENEALLREQQAGYGSQGNANDEYDAEQMRLKEHEHEQKLLAREQELRDIVANTNDKLIDISMINNSGIVIQGTDLQEALDKRQQEEGGDSREDERSAGDDNLSGHSVPSSGSAQATTHQTAPRTNTFTLLTSPDSAKISKEQLKKLHSNILNEIFSQSQVNKPGPLTVPF

SEQ ID NO: 244 - protein, 811 aa, Saccharomyces cerevisiae
MDDIITQVSPDNAESAPILQEQQQQQNSQYEGNEEDYGDSLIHLNIQENHYFITRDQLMSLPESLLLCLFPSGVFLDRCGQVITNLTRDDEVYIVNFPPDCFEYIMEIYTKAHDDLYNHPVEKFFDRPSSSFVSNAKGFFGLSSNNSISSNNEQDILHQKPAIIVLREDLDYYCVPQEEFQFDSTNEENNEDLLRHFMAQVKMAAGSYLTSKTSIFQGLYSSNRLKQQQQQQKIEKGSNSSSNTKSTSKKLGPAEQHLMDMLCSSGFTKETCWGNRTQETGKTVISSLSLCRLANETTEGFRQKFNEAKAKWEAEHKPSQDNFITPMQSNISINSLSASKSNSTISTARNLTSGSTAPATARDKRKSRLSKLADNVRSHSSSRHSSQTRSKPPELPKLYDLVPKPNINAKLLLFWRKPARKCWWGEEDIELEVEVFGSWKDESKKIIELILPTNVDPEAELHKIIVPVRLHIRRVWTLELSVIGVQGSAAPGASGSGSGSGMSSNNRKKLLLMGRSGSGKSSMRSIIFSNYSAFDTRRLGATIDVEHSHLRFLGNMTLNLWDCGGQDVFMENYFTKQKDHIFQMVQVLIHVFDVESTEVLKDIEIFAKALKQLRKYSPDAKIFVLLHKMDLVQLDKREELFQIMMKNLSETSSEFGFPNLIGFPTSIWDESLYKAWSQIVCSLIPNMSNHQSNLKKFKEIMNALEIILFERTTFLVICSSNGENSNENHDSSDNNNVLLDPKRFEKISNIMKNFKQSCTKLKSGFKTLILNNNIYVSELSSNMVCFIVLKDMNIPQELVLENIKKAKEFFQ

We claim:

1. A nucleic acid molecule comprising:
   (a) the nucleotide sequence SEQ ID NO: 47;
   (b) the nucleotide sequence that is complementary to the nucleotide sequence of SEQ ID NO: 47; or
   (c) a nucleotide sequence encoding an amino acid sequence that is at least 90% identical to SEQ ID NO: 110.

2. The nucleic acid molecule according to claim 1, wherein the nucleotide sequence encodes an amino acid sequence that is at least 95% identical to SEQ ID NO: 110.

3. A vector construct comprising:
   (a) a first nucleic acid having a regulatory sequence that causes transcription and/or translation; and
   (b) a second nucleic acid having the nucleotide sequence according to claim 1,
   wherein the first and second nucleic acids are operably linked.

4. The vector construct according to claim 3, wherein the first nucleic acid is SEQ ID NO:127 or SEQ ID NO:128.

5. A host cell comprising a vector construct according to claim 3.

6. A host cell comprising a nucleic acid molecule according to claim 1.

7. The nucleic acid molecule according to claim 1, wherein the nucleotide sequence encodes an amino acid sequence that is 100% identical to SEQ ID NO: 110.

* * * * *